United States Patent 11,446,398 (REGULATED BIOCIRCUIT SYSTEMS) - sequence listing, part 60

SEQ ID NO: 155774 - DNA, 17911 bp, Homo sapiens
  Payload ID: 10599
  Gene Symbol: MUC5B
  Gene Name: mucin 5B, oligomeric mucus/gel-forming
  Uniprot ID: Q9HC84
  ENST ID: ENST00000529681
  CDS Start-End: 59-17347
acccggcccggctccctccctgcccgtccccgtccccccacccgtgccagcccccaggatgggtgccccgagcgcgtgccggacgctggtgttggctctggcggccatgctcgtggtgccgcaggcagagacccagggccctgtggagccgagctgggagaatgcagggcacaccatggatggcggtgccccgacgtcctcgcccacccggcgcgtgagctttgttccacccgtcactgtcttccccagcctgagccccctgaacccggcgcacaatgggcgggtgtgcagcacctggggtgacttccactacaagaccttcgacggcgacgtcttccgcttccctggcctttgcaactacgtgttctctgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcgggaggagctgccttacagccgcactggcctcctggtggagcagagcggggactacatcaaggtcagcatccggctggtgctgacattcctgtggaacggagaggacagtgccctgctggagctggatcccaaatacgccaaccagacctgtggcctgtgtggggacttcaacggcctcccggccttcaacgagttctatgcccacaacgccaggctgaccccgctccagtttgggaacctgcagaagttggatgggcccacggagcagtgcccggacccgctgcccttgccggccggcaactgcacggacgaggagggcatctgccaccgcaccctgctggggccggcctttgcggagtgccacgcactggtggacagcactgcgtacctggccgcctgcgcccaggacctgtgccgctgccccacctgcccgtgtgccacctttgtggaatactcacgccagtgcgcccacgcggggggccagccgcggaactggaggtgccctgagctctgcccccggacctgccccctcaacatgcagcaccaggagtgtggctcaccctgcacggacacctgctccaacccccagcgcgcgcagctctgcgaggaccactgtgtggacggctgcttctgccccccaggcacggtgctggatgacatcacgcactctggctgcctgcccctcgggcagtgcccctgcacccacggcggccgcacctacagcccgggcacctccttcaacaccacctgcagctcctgcacctgctccggggggctatggcagtgccaggacctgccgtgccctggcacctgctctgtgcagggcggggcccacatctccacctatgatgagaaactctacgacctgcatggtgactgcagctacgttctgtccaagaaatgtgccgacagcagcttcaccgtgctggctgagctgcggaagtgcggcctgacggacaacgagaactgcctgaaagcggtgacgctcagcctggacggcggggacacggccatccgggtccaagcggacggcggcgtgttcctcaactccatctacacgcagctgcccctgtcggcagccaacatcaccctgttcacaccctcgagcttcttcatcgtggtgcagacaggcctggggctgcagctgctggtgcagctggtgccactcatgcaggtgtttgtcaggctggaccccgcccaccagggccagatgtgcggcctgtgtgggaacttcaaccagaaccaggctgacgacttcacggccctcagcggggtggtggaggccacgggcgcagccttcgccaacacctggaaggcccaggctgcctgtgccaatgccaggaacagctttgaggacccctgctccctcagtgtggagaatgagaactacgcccggcactggtgctcgcgcctgaccgatcccaacagtgccttctcgcgctgccactccatcatcaaccccaagcccttccactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagtacatgcagaactgccccaagtcccagcgctacgcctacgtggtggatgcctgccagcccacttgccgcggcctgagtgaggccgacgtcacctgcagcgtttccttcgtgcctgtggacggctgcacctgccccgcgggcaccttcctcaatgacgcgggcgcctgtgtgcccgcccaggagtgcccctgctacgctcacggcaccgtgctggctcctggagaggtggtgcacgacgagggcgccgtgtgttcatgtacgggtgggaagctaagctgcctgggagcctctctgcagaaaagcacagggtgtgcagcccccatggtgtacctggactgcagcaacagctcggcgggcacccctggggccgagtgcctccggagctgccacacgctggacgtgggctgtttcagcacacactgcgtgtccggctgtgtctgtcccccggggctggtgtcggatgggagtgggggctgcattgccgaggaggactgcccctgtgtgcacaacgaggccacctacaagcctggagagaccatcagggtcgactgcaacacctgcacctgcaggaaccggaggtgggagtgcagccaccggctctgcctgggcacctgcgtggcctacggggatggccacttcatcacctttgatggcgatcgctacagctttgaaggcagctgcgagtacatcttggcccaggactactgtggggacaacaccacccacgggaccttccgcatcgtcaccgagaacatcccctgtgggaccaccggcaccacctgctccaaggccatcaagctcttcgtggagagctacgagctgatcctccaagaggggacctttaaggcggtggcgagagggccgggtggggacccaccctacaagatacgctacatggggatcttcctggtcatcgagacccacgggatggccgtgtcctgggaccggaagaccagcgtgttcatccgactgcaccaggactacaagggcagggtctgcggcctgtgcgggaacttcgacgacaatgccatcaatgactttgccacgcgtagccggtccgtggtgggggacgcactggagtttgggaacagctggaagctctccccctcctgcccggacgccctggcacccaaggacccctgcacggccaaccccttccgcaagtcctgggcccagaagcagtgcagcatcctccacggccccaccttcgccgcctgccgctcccaggttgactccaccaagtactacgaggcctgcgtgaacgacgcgtgtgcctgcgactcgggtggcgactgcgagtgtttctgcacggctgtggctgcctacgcccaggcctgccacgacgcgggcctgtgtgtgtcctggcggactccggacacctgccccttgttctgtgacttctacaacccacatgggggctgtgagtggcactaccagccctgcggggcaccctgcctaaaaacctgccggaaccccagtgggcactgcctggtggacctgcctggcctggaaggctgctacccgaagtgcccacccagccagcccttcttcaatgaggaccagatgaagtgcgtggcccagtgtggctgctacgacaaggacggaaactactatgacgtcggtgcaagggtccccacagcggagaactgccagagctgtaactgcacacccagtggcatccagtgcgctcacagccttgaggcctgcacctgcacctatgaggacaggacctacagctaccaggacgtcatctacaacaccaccgatgggcttggcgcctgcttgatcgccatctgcggaagcaacggcaccatcatcaggaaggctgtggcatgtcctggaactccagccacaacgccattcaccttcaccaccgcctgggtcccccactccacgacaagcccggccctcccggtctccaccgtgtgtgtccgcgaggtctgccgctggtccagctggtacaatgggcaccgcccagagcccggcctgggaggcggagactttgagacgtttgaaaacctgaggcagagagggtaccaggtatgccctgtgctggctgacatcgagtgccgggcggcgcagcttcccgacatgccgctggaggagctgggccagcaggtggactgtgaccgcatgcgggggctgatgtgcgccaacagccaacagagtcccccgctctgtcacgactacgagctgcgggttctctgctgcgaatacgtgccctgtggcccctccccggccccaggcaccagccctcagccctccctcagtgccagcacggagcctgctgtgcctaccccaacccagaccacagcaaccgaaaagaccaccctatgggtgaccccgagcatccggtcgacggcggccctcacctcgcagactgggtccagctcaggccccgtgacggtcaccccctcggccccaggtaccaccacctgccagccccggtgtcagtggacagagtggtttgatgaggactaccccaagtctgaacaacttggaggggacgttgagtcctacgataagatcagggccgctggagggcacttatgccagcagcctaaggacatagagtgccaggccgagagcttccccaactggaccctggcacaggtggggcagaaggtgcactgtgacgtccacttcggcctggtgtgcaggaactgggagcaggagggcgtcttcaagatgtgctacaactacaggatccgggtcctctgctgcagtgacgaccactgcaggggacgtgccacaaccccgccaccgaccacagagctggagacggccaccaccaccaccacccaggccctgttctcaacgccgcagcctacgagtagcccggggctgaccagggctcccccggccagcaccacagcagtccccaccctctcagaaggactgacatcccccagatacacaagcacccttggtacagccaccacgggaggccccacgacgcctgcaggctccacagaacccactgtcccaggggtggccacatccacccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccgccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccatggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgaccccctcctccatcccggggaccacccacacccccacagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttctccagggacgaccaccccgggccacaccagggccacctccaggaccacggccacggccacacccagcaagacccgcacctcgaccctgctgcccagcagccccacatcggccccaataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctccactccagggacgacctggatcctcacagagcagaccacagcagccactacgaccgcaaccactggatccacggccatcccgtcctccaccccgggaacagctccccctcccaaagtgctgaccagcacggccaccacacccacagccaccagttccaaagccacttcctcctccagtccaaggactgcaaccacccttccagtgctgacaagcacagccaccaaatccacagctaccagctttacacccatcccctccttcacccttgggaccaccgggaccctcccagaacagaccaccacacccatggccaccatgtccacaatccacccctcctccactccggagaccacccacacctccacagtgctgaccacgaaggccaccacgacaagggccaccagttccatgtccaccccctcctccactccggggacgacctggatcctcacagagctgaccacagcagccactacaactgcagccactggccccacggccaccccgtcctccaccccagggaccacctggatcctcacagagcccagcactacagccaccgtgacggtgcccaccggatccacggccaccgcctcctccacccgggcaactgctggcaccctcaaagtgctgaccagcacggccaccacacccacagtcatcagctccagagccactccctcctccagtccagggactgcaaccgcccttccagcactgagaagcacagccaccacacccacagctaccagcgttacagccatcccctcttcctccctgggcaccgcctggacccgcctatcacagaccaccacacccacggccaccatgtccacagccacaccctcctctactccagagactgtccacacctccacagtgcttaccaccacgaccaccacaaccagggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacagccaccggctccaccaccaacccctcctcaactccagggacaactcccatccccccagtgctgaccaccaccgccaccacacctgcagccaccagcagcacagtgactccctcctctgccctagggaccacccacacacccccagtgccgaacaccacggccaccacacacgggcggtccctgccccccagcagtccccacacggtgcgcacagcctggacttcggccacctcgggcatcttgggcaccacccacatcacagagccttccacggtgacttcccacaccccagcagcaaccaccagtaccacccagcactcgactccagccctgtccagccctcaccctagcagcaggaccaccgagtcacccccttctccagggacgaccaccccgggccacaccaggggcacctccaggaccacagccacagccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggcagtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcaactccggggacgacctggatcctcacaaagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccaccacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccgtcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctagcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatcaccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttctctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccaggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagta

SEQ ID NO: 155775 - DNA, 8006 bp, Homo sapiens
  Payload ID: 10600
  Gene Symbol: MUC6
  Gene Name: mucin 6, oligomeric mucus/gel-forming
  Uniprot ID: Q6W4X9
  ENST ID: ENST00000421673
  CDS Start-End: 52-7371
ggcagcagcaggcctgccgggcccagcgcgagctcctctccactgtgcaccatggtccagcggtggctgctgctgtcctgctgcggagccctgctcagcgctggtctggctaacacctcctacaccagcccaggcctccagaggctgaaggactctccacagacagccccggacaaaggccagtgctccacgtggggggctggtcacttctccaccttcgaccaccacgtgtacgacttctcggggacgtgcaactacatcttcgcggccacctgcaaggacgccttccccaccttcagtgtccagctgcggcgaggcccagacgggagcatctcgcggatcatcgtggagctgggggcctccgtcgtcactgtgagcgaagccatcatctcagtcaaggacatcggggtcatcagcctgccctataccagcaatggactccagatcacacccttcggccagagcgtgcggctggtggccaagcagctggagctggagctggaagtcgtgtggggtcctgacagccacctcatggttctggtggagcggaagtacatgggtcagatgtgcgggctctgcgggaactttgacgggaaggtgaccaacgagtttgtcagtgaggagggcaagttcctggaaccccacaagtttgctgccctccagaagctggacgaccccggcgagatctgcaccttccaggacatccccagcacccacgtccggcaggcccagcacgcccggatctgcacccagctgctgaccctggtggcccctgagtgcagcgtgtccaaggagcccttcgtgctaagctgccaggcggacgtggccgcagccccccagccaggcccacagaacagcagttgtgccaccctgtcggagtactcccgccagtgcagcatggtgggccagccggtccgccgctggcggagccccggcctgtgctccgtgggtcagtgcccggccaaccaggtgtaccaggagtgcggctcggcctgcgtgaagacctgctccaacccgcagcacagctgctccagctcctgcaccttcgggtgcttctgcccggaaggtacggtcctgaatgacctctccaataaccacacctgcgtgcccgtcacccagtgcccctgtgtgctccacggcgccatgtatgcccccggggaggtcacaatagctgcctgccaaacctgccggtgcaccctgggccgctgggtgtgcacggagcggccgtgccccggacactgctccctggaaggtggctcctttgttaccacatttgacgccaggccctaccgcttccacggcacctgcacctacatcctcctccagagcccccagcttcccgaggacggtgccctcatggctgtgtacgacaagtccggcgtctcacactccgagacctccctggtggctgtggtctacctctccaggcaggacaaaattgtgatctctcaggacgaggtggtcaccaacaacggagaagccaagtggctgccatacaagactcgcaacatcacggtcttcaggcagacgtccacccacctccagatggccaccagcttcgggctggagctcgtggtccagctgcgccccatcttccaggcctatgtcactgttgggccccagttcagaggtcagaccagagggctctgcggcaacttcaacggggacacaacggatgacttcaccactagcatgggtatcgccgagggcaccgcctcgctgtttgtggactcctggcgggcggggaactgtccggccgctctggagcgtgagactgacccctgctccatgagccagctcaacaaggtgtgtgcagagacccactgctccatgctgctgaggacaggcacggtgttcgagaggtgccacgccacagtgaaccctgcacccttctacaagaggtgcgtgtaccaggcctgcaactacgaggagacctttccccacatctgtgccgccctgggcgactacgtacacgcctgctccttgcggggcgtcctgctctggggctggagaagcagtgtggacaactgcaccatcccctgcacgggtaacaccaccttcagctacaacagccaagcctgtgagcgcacctgcctgtcgctgtcggaccgtgccaccgagtgccaccacagcgccgtgcccgtggacggttgcaactgccccgatggcacctacctgaaccaaaagggcgagtgtgtgcgcaaggcccagtgcccgtgcatactggagggttacaagttcatcctggccgagcagtccactgtcatcaacggcatcacctgccactgcatcaacgggcggctgagttgcccgcagcggccacagatgttcctggcctcctgccaggcccctaagaccttcaagtcctgcagccagtcctccgagaacaagtttggggcagcctgtgcccccacatgccagatgctggccaccggtgttgcctgcgtgcccaccaagtgtgagcctggctgtgtctgcgccgagggcctctacgagaatgccgacgggcagtgtgtgccccccgaggagtgcccatgtgagttctcgggggtctcctaccctggaggagctgagctccacactgactgcaggacctgctcctgctcaagggggaggtgggcctgtcagcagggcacccactgcccatccacctgcaccctctacggggagggccacgtcatcaccttcgacggccagcgcttcgtattcgacggcaactgcgagtacatcctggccacggacgtctgtggtgtcaacgactcacagcccaccttcaagatcctgacagagaacgtcatctgtgggaactccggggtcacatgctcacgggccatcaagatcttcctggggggcctgtccgtggtgctggcggacagaaactacacggtcaccggggaggagccccacgtgcagctcggggtgacgccgggtgcgctgagccttgtcgtggacatcagcatccccgggaggtacaacctgacgctcatctggaacaggcacatgaccatcctcatcaggatcgcccgtgcctcccaggatcccctctgcggcttgtgtggcaacttcaacgggaacatgaaggacgacttcgagacgcgcagcaggtacgtggcatccagcgagctggagttggtgaactcgtggaaggagagcccgctgtgcggggacgtgagcttcgtgacagacccctgcagtctcaatgccttccggcgctcctgggccgagcgcaagtgcagcgtcatcaacagccagacctttgccacctgccacagcaaggtataccacctgccctactacgaggcctgcgtgcgcgacgcatgtgggtgtgacagtggcggggactgtgagtgtctgtgcgatgccgtggctgcctacgcccaagcctgtctggacaagggtgtgtgcgtggactggaggaccccggccttctgccccatctactgcggcttctacaacacgcacacgcaggacggccatggcgagtaccagtacacacaggaggccaactgcacgtggcactaccagccctgcctctgccccagccagccacagagcgtcccaggcagcaacatcgaaggctgctacaactgctcccaggatgagtacttcgaccacgaggagggggtgtgcgtgccctgcatgccgcccaccacgccgcagccacccaccacgccgcagctgcccaccacaggctcacggcccacgcaagtctggcccatgacgggaacctccaccaccatcgggcttctcagctccaccggaccctcacccagctctaatcacacccctgccagccccacccagacacccctccttccagccacgctcacatcctccaagcccacagcctcctcgggagaaccacctagaccaaccacggccgtcaccccacaagccacatcagggctgcctcccacagccacactgagatcgacagccacaaaacccacagtgacccaggccacaaccagggccacggcgtcgaccgccagcccagccacgacgtccacagctcagtccacaacacggaccacaatgacactaccaaccccagccacatcagggacaagccccacgctgccaaaatcgaccaatcaggaactgccaggaacaacggccacccagacgacaggcccacgtccaaccccagcaagcaccacaggcccaaccaccccacagccaggacaacccacgaggcccacagccacagagaccactcaaacaagaacgactactgaatacacaacgccccaaaccccacacaccacacactccccgcctacggcggggagtcccgtcccttccacaggtcctgtcactgcaacatctttccatgccaccactacctatccaaccccatcacaccctgagaccacacttcccactcacgttccacctttctccacctccttggtgactccaagtactcacacagtcatcacccctacccacgcacagatggccacatctgcctccaaccactcagcgccaacaggtaccattcctccaccaacaacgctcaaggccacagggtccacccacacagccccaccaataacgccgaccaccagtgggaccagccaagcccacagctcattcagcacaaacaaaacacctacctcgctacattcacacacttcctccacacaccatcctgaagtcaccccaacttctactaccacgattactcccaaccccactagtacacgcaccagaacccctgtggcccacaccaactcagccaccagcagcaggccaccaccacccttcaccacacactccccacctacagggagcagtcccttctcttccacaggtcccatgacggcaacatccttcaagaccaccactacctatccaaccccatcacaccctcagaccacacttcccactcacgttccacctttctccacctctttggtgactccaagtactcacacagtcatcacccctacccatgcacagatggccacttctgcctccatccactcaatgccaacaggcacgattcctccaccgacaacgctcaaggccacagggtccacccacacagcgccaacaatgacgctgaccaccagcgggaccagccaagccctgagctcattaaacacagccaaaacctctacatccctacattcacacacttcctccacacaccatgctgaagccacctcaacttctaccaccaacatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagaacccctgtggcccacaccacgtcggccaccagcagcaggctacccacacccttcaccacacactccccacctacagggaccactcccatctcttccacaggtcctgtcactgcaacatccttccagaccaccactacctatccaaccccatcacaccctcacaccacacttcccactcacgttccatctttctccacctccttggtgactccaagtactcacacggtcatcatccctacccacacacagatggccacttctgcctccatccactcaatgccaacaggcaccattcctccaccgaccacgatcaaggccacagggtccacccacacagccccaccaatgacaccgaccaccagtgggaccagccaatccccaagctcatttagcacggccaaaacttctacatccctaccttaccacacttcctcaacacaccatcctgaagtcaccccaacttctaccaccaacatcacccccaaacacaccagtacaggcaccagaacccctgtggcccacaccacctcggccagcagcagcaggctacccacacccttcaccacacactccccacctacagggagcagtcccttctcttccacaggtcctatgactgcaacatccttccagaccaccactacctatccaaccccatcacaccctcagaccacacttcccactcacgttccacctttctccacctccttggtgactccaagtactcacacagtcatcatcactacccacacacagatggccacttctgcctccatccactcaacgccaacaggcaccgttcctccaccaacaacgctcaaggccacagggtccacccacacagccccaccaatgacagtgaccaccagtgggaccagccaaacccacagctcattcagcacagctacagcctcttcttccttcatatcctcctcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccaccgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaaggcaca

SEQ ID NO: 155776 - DNA, 656 bp, Homo sapiens
  Payload ID: 10600
  Gene Symbol: MUC6
  Gene Name: mucin 6, oligomeric mucus/gel-forming
  ENST ID: ENST00000532016
  CDS Start-End: 1-656
ctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggtgagtccacaggtgggaggcctgccccacgtccaccaaggtgctcacaaccccaccccagagaggttcgggcaccccacccaggcgcctgctgccccatcagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctg

SEQ ID NO: 155777 - DNA, 553 bp, Homo sapiens
  Payload ID: 10600
  Gene Symbol: MUC6
  Gene Name: mucin 6, oligomeric mucus/gel-forming
  ENST ID: ENST00000525923
  CDS Start-End: 11-553
cccacgggccatggacacttctcgcacgccgagtgtgtgcagggaaacgggcggagcagccctgagcagaggtgagcggcgccctcagggacgacggggtagccccacaccgactgcgggtcccgtccacacaggtctggctaacacctcctacaccagcccaggcctccagaggctgaaggactctccacagacagccccggacaaaggccagtgctccacgtggggggctggtcacttctccaccttcgaccaccacgtgtacgacttctcggggacgtgcaactacatcttcgcggccacctgcaaggacgccttccccaccttcagtgtccagctgcggcgaggcccagacgggagcatctcgcggatcatcgtggagctgggggcctccgtcgtcactgtgagcgaagccatcatctcagtcaaggacatcggggtcatcagcctgccctataccagcaatggactccagatcacacccttcggccagagcgtgcggctggtggccaagcagctggagctggagctggaagtcgtgtggggtcctgac

SEQ ID NO: 155778 - DNA, 404 bp, Homo sapiens
  Payload ID: 10600
  Gene Symbol: MUC6
  Gene Name: mucin 6, oligomeric mucus/gel-forming
  ENST ID: ENST00000527242
  CDS Start-End: 1-347
tgccgcccaccacgccgcagccacccaccacgccgcagctgcccaccacaggctcacggcccacgcaagtctggcccatgacgggaacctccaccaccatcgggcttctcagctccaccggaccctcacccagctctaatcacacccctgccagccccacccagacacccctccttccagccacgctcacatcctccaagcccacagcctcctcgggaggtaaggagcctccagctgagcccatggagagggcagctgcaggaggtcctaggtacacctctggggtgggcttagggatggccctgcttcctggctcacatctgccactaagcagattcccagcgtagaacttcctatgcttgggagccaaactggggatttttcggaaaaacttttaaagacaa

SEQ ID NO: 155779 - DNA, 8003 bp, Homo sapiens
  Payload ID: 10600
  Gene Symbol: MUC6
  Gene Name: mucin 6, oligomeric mucus/gel-forming
  ENST ID: ENST00000619759
  CDS Start-End: 52-7371
ggcagcagcaggcctgccgggcccagcgcgagctcctctccactgtgcaccatggtccagcggtggctgctgctgtcctgctgcggagccctgctcagcgctggtctggctaacacctcctacaccagcccaggcctccagaggctgaaggactctccacagacagccccggacaaaggccagtgctccacgtggggggctggtcacttctccaccttcgaccaccacgtgtacgacttctcggggacgtgcaactacatcttcgcggccacctgcaaggacgccttccccaccttcagtgtccagctgcggcgaggcccagacgggagcatctcgcggatcatcgtggagctgggggcctccgtcgtcactgtgagcgaagccatcatctcagtcaaggacatcggggtcatcagcctgccctataccagcaatggactccagatcacacccttcggccagagcgtgcggctggtggccaagcagctggagctggagctggaagtcgtgtggggtcctgacagccacctcatggttctggtggagcggaagtacatgggtcagatgtgcgggctctgcgggaactttgacgggaaggtgaccaacgagtttgtcagtgaggagggcaagttcctggaaccccacaagtttgctgccctccagaagctggacgaccccggcgagatctgcaccttccaggacatccccagcacccacgtccggcaggcccagcacgcccggatctgcacccagctgctgaccctggtggcccctgagtgcagcgtgtccaaggagcccttcgtgctaagctgccaggcggacgtggccgcagccccccagccaggcccacagaacagcagttgtgccaccctgtcggagtactcccgccagtgcagcatggtgggccagccggtccgccgctggcggagccccggcctgtgctccgtgggtcagtgcccggccaaccaggtgtaccaggagtgcggctcggcctgcgtgaagacctgctccaacccgcagcacagctgctccagctcctgcaccttcgggtgcttctgcccggaaggtacggtcctgaatgacctctccaataaccacacctgcgtgcccgtcacccagtgcccctgtgtgctccacggcgccatgtatgcccccggggaggtcacaatagctgcctgccaaacctgccggtgcaccctgggccgctgggtgtgcacggagcggccgtgccccggacactgctccctggaaggtggctcctttgttaccacatttgacgccaggccctaccgcttccacggcacctgcacctacatcctcctccagagcccccagcttcccgaggacggtgccctcatggctgtgtacgacaagtccggcgtctcacactccgagacctccctggtggctgtggtctacctctccaggcaggacaaaattgtgatctctcaggacgaggtggtcaccaacaacggagaagccaagtggctgccatacaagactcgcaacatcacggtcttcaggcagacgtccacccacctccagatggccaccagcttcgggctggagctcgtggtccagctgcgccccatcttccaggcctatgtcactgttgggccccagttcagaggtcagaccagagggctctgcggcaacttcaacggggacacaacggatgacttcaccactagcatgggtatcgccgagggcaccgcctcgctgtttgtggactcctggcgggcggggaactgtccggccgctctggagcgtgagactgacccctgctccatgagccagctcaacaaggtgtgtgcagagacccactgctccatgctgctgaggacaggcacggtgttcgagaggtgccacgccacagtgaaccctgcacccttctacaagaggtgcgtgtaccaggcctgcaactacgaggagacctttccccacatctgtgccgccctgggcgactacgtacacgcctgctccttgcggggcgtcctgctctggggctggagaagcagtgtggacaactgcaccatcccctgcacgggtaacaccaccttcagctacaacagccaagcctgtgagcgcacctgcctgtcgctgtcggaccgtgccaccgagtgccaccacagcgccgtgcccgtggacggttgcaactgccccgatggcacctacctgaaccaaaagggcgagtgtgtgcgcaaggcccagtgcccgtgcatactggagggttacaagttcatcctggccgagcagtccactgtcatcaacggcatcacctgccactgcatcaacgggcggctgagttgcccgcagcggccacagatgttcctggcctcctgccaggcccctaagaccttcaagtcctgcagccagtcctccgagaacaagtttggggcagcctgtgcccccacatgccagatgctggccaccggtgttgcctgcgtgcccaccaagtgtgagcctggctgtgtctgcgccgagggcctctacgagaatgccgacgggcagtgtgtgccccccgaggagtgcccatgtgagttctcgggggtctcctaccctggaggagctgagctccacactgactgcaggacctgctcctgctcaagggggaggtgggcctgtcagcagggcacccactgcccatccacctgcaccctctacggggagggccacgtcatcaccttcgacggccagcgcttcgtattcgacggcaactgcgagtacatcctggccacggacgtctgtggtgtcaacgactcacagcccaccttcaagatcctgacagagaacgtcatctgtgggaactccggggtcacatgctcacgggccatcaagatcttcctggggggcctgtccgtggtgctggcggacagaaactacacggtcaccggggaggagccccacgtgcagctcggggtgacgccgggtgcgctgagccttgtcgtggacatcagcatccccgggaggtacaacctgacgctcatctggaacaggcacatgaccatcctcatcaggatcgcccgtgcctcccaggatcccctctgcggcttgtgtggcaacttcaacgggaacatgaaggacgacttcgagacgcgcagcaggtacgtggcatccagcgagctggagttggtgaactcgtggaaggagagcccgctgtgcggggacgtgagcttcgtgacagacccctgcagtctcaatgccttccggcgctcctgggccgagcgcaagtgcagcgtcatcaacagccagacctttgccacctgccacagcaaggtataccacctgccctactacgaggcctgcgtgcgcgacgcatgtgggtgtgacagtggcggggactgtgagtgtctgtgcgatgccgtggctgcctacgcccaagcctgtctggacaagggtgtgtgcgtggactggaggaccccggccttctgccccatctactgcggcttctacaacacgcacacgcaggacggccatggcgagtaccagtacacacaggaggccaactgcacgtggcactaccagccctgcctctgccccagccagccacagagcgtcccaggcagcaacatcgaaggctgctacaactgctcccaggatgagtacttcgaccacgaggagggggtgtgcgtgccctgcatgccgcccaccacgccgcagccacccaccacgccgcagctgcccaccacaggctcacggcccacgcaagtctggcccatgacgggaacctccaccaccatcgggcttctcagctccaccggaccctcacccagctctaatcacacccctgccagccccacccagacacccctccttccagccacgctcacatcctccaagcccacagcctcctcgggagaaccacctagaccaaccacggccgtcaccccacaagccacatcagggctgcctcccacagccacactgagatcgacagccacaaaacccacagtgacccaggccacaaccagggccacggcatcgaccgccagcccagccacgacgtccacagctcagtccacaacacggaccacaatgacactaccaaccccagccacatcagggacaagccccacgctgccaaaatcgaccaatcaggaactgccaggaacaacggccacccagacgacaggcccacgtccaaccccagcaagcaccacaggcccaaccaccccacagccaggacaacccacgaggcccacagccacagagaccactcaaacaagaacgactactgaatacacaacgccccaaaccccacacaccacacactccccgcctacggcggggagtcccgtcccttccacaggtcctgtcactgcaacatctttccatgccaccactacctatccaaccccatcacaccctgagaccacacttcccactcacgttccacctttctccacctccttggtgactccaagtactcacacagtcatcacccctacccacgcacagatggccacatctgcctccaaccactcagcgccaacaggtaccattcctccaccaacaacgctcaaggccacagggtccacccacacagccccaccaataacgccgaccaccagtgggaccagccaagcccacagctcattcagcacaaacaaaacacctacctcgctacattcacacacttcctccacacaccatcctgaagtcaccccaacttctactaccacgattactcccaaccccactagtacacgcaccagaacccctgtggcccacaccaactcagccaccagcagcaggccaccaccacccttcaccacacactccccacctacagggagcagtcccttctcttccacaggtcccatgacggcaacatccttcaagaccaccactacctatccaaccccatcacaccctcagaccacacttcccactcacgttccacctttctccacctccttggtgactccaagtactcacacagtcatcacccctacccatgcacagatggccacttctgcctccatccactcaatgccaacaggcacgattcctccaccgacaacgctcaaggccacagggtccacccacacagcgccaacaatgacgccgaccaccagtgggaccagccaagccctgagctcattaaacacagccaaaacctctacatccctacattcacacacttcctccacacaccatgctgaagccacctcaacttctaccaccaacatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagaacccctgtggcccacaccacgtcggccaccagcagcaggctacccacacccttcaccacacactccccacctacagggaccactcccatctcttccacaggtcctgtcactgcaacatccttccagaccaccactacctatccaaccccatcacaccctcacaccacacttcccactcacgttccatctttctccacctccttggtgactccaagtactcacacggtcatcatccctacccacacacagatggccacttctgcctccatccactcaatgccaacaggcaccattcctccaccgaccacgatcaaggccacagggtccacccacacagccccaccaatgacaccgaccaccagtgggaccagccaatccccaagctcatttagcacggccaaaacttctacatccctaccttaccacacttcctcaacacaccatcctgaagtcaccccaacttctaccaccaacatcacccccaaacacaccagtacaggcaccagaacccctgtggcccacaccacctcggccagcagcagcaggctacccacacccttcaccacacactccccacctacagggagcagtcccttctcttccacaggtcctatgactgcaacatccttccagaccaccactacctatccaaccccatcacaccctcagaccacacttcccactcacgttccacctttctccacctccttggtgactccaagtactcacacagtcatcatcactacccacacacagatggccacttctgcctccatccactcaacgccaacaggcaccgttcctccaccaacaacgctcaaggccacagggtccacccacacagccccaccaatgacagtgaccaccagtgggaccagccaaacccacagctcattcagcacagctacagcctcttcttccttcatatcctcctcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccaccgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaaggc

SEQ ID NO: 155780 - DNA, 8003 bp, Homo sapiens
  Payload ID: 10600
  Gene Symbol: MUC6
  Gene Name: mucin 6, oligomeric mucus/gel-forming
  ENST ID: ENST00000621433
  CDS Start-End: 52-7371
ggcagcagcaggcctgccgggcccagcgcgagctcctctccactgtgcaccatggtccagcggtggctgctgctgtcctgctgcggagccctgctcagcgctggtctggctaacacctcctacaccagcccaggcctccagaggctgaaggactctccacagacagccccggacaaaggccagtgctccacgtggggggctggtcacttctccaccttcgaccaccacgtgtacgacttctcggggacgtgcaactacatcttcgcggccacctgcaaggacgccttccccaccttcagtgtccagctgcggcgaggcccagacgggagcatctcgcggatcatcgtggagctgggggcctccgtcgtcactgtgagcgaagccatcatctcagtcaaggacatcggggtcatcagcctgccctataccagcaatggactccagatcacacccttcggccagagcgtgcggctggtggccaagcagctggagctggagctggaagtcgtgtggggtcctgacagccacctcatggttctggtggagcggaagtacatgggtcagatgtgcgggctctgcgggaactttgacgggaaggtgaccaacgagtttgtcagtgaggagggcaagttcctggaaccccacaagtttgctgccctccagaagctggacgaccccggcgagatctgcaccttccaggacatccccagcacccacgtccggcaggcccagcacgcccggatctgcacccagctgctgaccctggtggcccctgagtgcagcgtgtccaaggagcccttcgtgctaagctgccaggcggacgtggccgcagccccccagccaggcccacagaacagcagttgtgccaccctgtcggagtactcccgccagtgcagcatggtgggccagccggtccgccgctggcggagccccggcctgtgctccgtgggtcagtgcccggccaaccaggtgtaccaggagtgcggctcggcctgcgtgaagacctgctccaacccgcagcacagctgctccagctcctgcaccttcgggtgcttctgcccggaaggtacggtcctgaatgacctctccaataaccacacctgcgtgcccgtcacccagtgcccctgtgtgctccacggcgccatgtatgcccccggggaggtcacaatagctgcctgccaaacctgccggtgcaccctgggccgctgggtgtgcacggagcggccgtgccccggacactgctccctggaaggtggctcctttgttaccacatttgacgccaggccctaccgcttccacggcacctgcacctacatcctcctccagagcccccagcttcccgaggacggtgccctcatggctgtgtacgacaagtccggcgtctcacactccgagacctccctggtggctgtggtctacctctccaggcaggacaaaattgtgatctctcaggacgaggtggtcaccaacaacggagaagccaagtggctgccatacaagactcgcaacatcacggtcttcaggcagacgtccacccacctccagatggccaccagcttcgggctggagctcgtggtccagctgcgccccatcttccaggcctatgtcactgttgggccccagttcagaggtcagaccagagggctctgcggcaacttcaacggggacacaacggatgacttcaccactagcatgggtatcgccgagggcaccgcctcgctgtttgtggactcctggcgggcggggaactgtccggccgctctggagcgtgagactgacccctgctccatgagccagctcaacaaggtgtgtgcagagacccactgctccatgctgctgaggacaggcacggtgttcgagaggtgccacgccacagtgaaccctgcacccttctacaagaggtgcatgtaccaggcctgcaactacgaggagacctttccccacatctgtgccgccctgggcgactacgtacacgcctgctccttgcggggcgtcctgctctggggctggagaagcagtgtggacaactgcaccatcccctgcacgggtaacaccaccttcagctacaacagccaagcctgtgagcgcacctgcctgtcgctgtcggaccgtgccaccgagtgccaccacagcgccgtgcccgtggacggttgcaactgccccgatggcacctacctgaaccaaaagggcgagtgtgtgcgcaaggcccagtgcccgtgcatactggagggttacaagttcatcctggccgagcagtccactgtcatcaacggcatcacctgccactgcatcaacgggcggctgagttgcccgcagcggccacagatgttcctggcctcctgccaggcccctaagaccttcaagtcctgcagccagtcctccgagaacaagtttggggcagcctgtgcccccacatgccagatgctggccaccggtgttgcctgcgtgcccaccaagtgtgagcctggctgtgtctgcgccgagggcctctacgagaatgccgacgggcagtgtgtgccccccgaggagtgcccatgtgagttctcgggggtctcctaccctggaggagctgagctccacactgactgcaggacctgctcctgctcaagggggaggtgggcctgtcagcagggcacccactgcccatccacctgcaccctctacggggagggccacgtcatcaccttcgacggccagcgcttcgtattcgacggcaactgcgagtacatcctggccacggacgtctgtggtgtcaacgactcacagcccaccttcaagatcctgacagagaacgtcatctgtgggaactccggggtcacatgctcacgggccatcaagatcttcctggggggcctgtccgtggtgctggcggacagaaactacacggtcaccggggaggagccccacgtgcagctcggggtgacgccgggtgcgctgagccttgtcgtggacatcagcatccccgggaggtacaacctgacgctcatctggaacaggcacatgaccatcctcatcaggatcgcccgtgcctcccaggatcccctctgcggcttgtgtggcaacttcaacgggaacatgaaggacgacttcgagacgcgcagcaggtacgtggcatccagcgagctggagttggtgaactcgtggaaggagagcccgctgtgcggggacgtgagcttcgtgacagacccctgcagtctcaatgccttccggcgctcctgggccgagcgcaagtgcagcgtcatcaacagccagacctttgccacctgccacagcaaggtataccacctgccctactacgaggcctgcgtgcgcgacgcatgtgggtgtgacagtggcggggactgtgagtgtctgtgcgatgccgtggctgcctacgcccaagcctgtctggacaagggtgtgtgcgtggactggaggaccccggccttctgccccatctactgcggcttctacaacacgcacacgcaggacggccatggcgagtaccagtacacacaggaggccaactgcacgtggcactaccagccctgcctctgccccagccagccacagagcgtcccaggcagcaacatcgaaggctgctacaactgctcccaggatgagtacttcgaccacgaggagggggtgtgcgtgccctgcatgccgcccaccacgccgcagccacccaccacgccgcagctgcccaccacaggctcacggcccacgcaagtctggcccatgacgggaacctccaccaccatcgggcttctcagctccaccggaccctcacccagctctaatcacacccctgccagccccacccagacacccctccttccagccacgctcacatcctccaagcccacagcctcctcgggagaaccacctagaccaaccacggccgtcaccccacaagccacatcagggctgcctcccacagccacactgagatcgacagccacaaaacccacagtgacccaggccacaaccagggccacggcatcgaccgccagcccagccacgacgtccacagctcagtccacaacacggaccacaatgacactaccaaccccagccacatcagggacaagccccacgctgccaaaatcgaccaatcaggaactgccaggaacaacggccacccagacgacaggcccacgtccaaccccagcaagcaccacaggcccaaccaccccacagccaggacaacccacgaggcccacagccacagagaccactcaaacaagaacgactactgaatacacaacgccccaaaccccacacaccacacactccccgcctacggcggggagtcccgtcccttccacaggtcctgtcactgcaacatctttccatgccaccactacctatccaaccccatcacaccctgagaccacacttcccactcacgttccacctttctccacctccttggtgactccaagtactcacacagtcatcacccctacccacgcacagatggccacatctgcctccatccactcagcgccaacaggtaccattcctccaccaacaacgctcaaggccacagggtccacccacacagccccaccaataacgccgaccaccagtgggaccagccaagcccacagctcattcagcacaaacaaaacacctacctcgctacattcacacacttcctccacacaccatcctgaagtcaccccaacttctactaccacgattactcccaaccccactagtacacgcaccagaacccctgtggcccacaccaactcagccaccagcagcaggccaccaccacccttcaccacacactccccacctacagggagcagtcccttctcttccacaggtcccatgacggcaacatccttcaagaccaccactacctatccaaccccatcacaccctcagaccacacttcccactcacgttccacctttctccacctctttggtgactccaagtactcacacagtcatcacccctacccatgcacagatggccacttctgcctccatccactcaatgccaacaggcacgattcctccaccgacaacgctcaaggccacagggtccacccacacagcgccaacaatgacgctgaccaccagcgggaccagccaagccctgagctcattaaacacagccaaaacctctacatccctacattcacacacttcctccacacaccatgctgaagccacctcaacttctaccaccaacatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagaacccctgtggcccacaccacgtcggccaccagcagcaggctacccacacccttcaccacacactccccacctacagggaccactcccatctcttccacaggtcctgtcactgcaacatccttccagaccaccactacctatccaaccccatcacaccctcacaccacacttcccactcacgttccatctttctccacctccttggtgactccaagtactcacacggtcatcatccctacccacacacagatggccacttctgcctccatccactcaatgccaacaggcaccattcctccaccgaccacgatcaaggccacagggtccacccacacagccccaccaatgacaccgaccaccagtgggaccagccaatccccaagctcatttagcacggccaaaacttctacatccctaccttaccacacttcctcaacacaccatcctgaagtcaccccaacttctaccaccaacatcacccccaaacacaccagtacaggcaccagaacccctgtggcccacaccacctcggccagcagcagcaggctacccacacccttcaccacacactccccacctacagggagcagtcccttctcttccacaggtcctatgactgcaacatccttccagaccaccactacctatccaaccccatcacaccctcagaccacacttcccactcacgttccacctttctccacctccttggtgactccaagtactcacacagtcatcatcactacccacacacagatggccacttctgcctccatccactcaacgccaacaggcaccgttcctccaccaacaacgctcaaggccacagggtccacccacacagccccaccaatgacagtgaccaccagtgggaccagccaaacccacagctcattcagcacagctacagcctcttcttccttcatatcctcctcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccactgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaaggc

SEQ ID NO: 155781 - DNA, 12809 bp, Homo sapiens
  Payload ID: 10600
  Gene Symbol: MUC6
  Gene Name: mucin 6, oligomeric mucus/gel-forming
  ENST ID: ENST00000627926
  CDS Start-End: 52-12174
ggcagcagcaggcctgccgggcccagcgcgagctcctctccactgtgcaccatggtccagcggtggctgctgctgtcctgctgcggagccctgctcagcgctggtctggctaacacctcctacaccagcccaggcctccagaggctgaaggactctccacagacagccccggacaaaggccagtgctccacgtggggggctggtcacttctccaccttcgaccaccacgtgtacgacttctcggggacgtgcaactacatcttcgcggccacctgcaaggacgccttccccaccttcagtgtccagctgcggcgaggcccagacgggagcatctcgcggatcatcgtggagctgggggcctccgtcgtcactgtgagcgaagccatcatctcagtcaaggacatcggggtcatcagcctgccctataccagcaatggactccagatcacacccttcggccagagcgtgcggctggtggccaagcagctggagctggagctggaagtcgtgtggggtcctgacagccacctcatggttctggtggagcggaagtacatgggtcagatgtgcgggctctgcgggaactttgacgggaaggtgaccaacgagtttgtcagtgaggagggcaagttcctggaaccccacaagtttgctgccctccagaagctggacgaccccggcgagatctgcaccttccaggacatccccagcacccacgtccggcaggcccagcacgcccggatctgcacccagctgctgaccctggtggcccctgagtgcagcgtgtccaaggagcccttcgtgctaagctgccaggcggacgtggccgcagccccccagccaggcccacagaacagcagttgtgccaccctgtcggagtactcccgccagtgcagcatggtgggccagccggtccgccgctggcggagccccggcctgtgctccgtgggtcagtgcccggccaaccaggtgtaccaggagtgcggctcggcctgcgtgaagacctgctccaacccgcagcacagctgctccagctcctgcaccttcgggtgcttctgcccggaaggtacggtcctgaatgacctctccaataaccacacctgcgtgcccgtcacccagtgcccctgtgtgctccacggcgccatgtatgcccccggggaggtcacaatagctgcctgccaaacctgccggtgcaccctgggccgctgggtgtgcacggagcggccgtgccccggacactgctccctggaaggtggctcctttgttaccacatttgacgccaggccctaccgcttccacggcacctgcacctacatcctcctccagagcccccagcttcccgaggacggtgccctcatggctgtgtacgacaagtccggcgtctcacactccgagacctccctggtggctgtggtctacctctccaggcaggacaaaattgtgatctctcaggacgaggtggtcaccaacaacggagaagccaagtggctgccatacaagactcgcaacatcacggtcttcaggcagacgtccacccacctccagatggccaccagcttcgggctggagctcgtggtccagctgcgccccatcttccaggcctatgtcactgttgggccccagttcagaggtcagaccagagggctctgcggcaacttcaacggggacacaacggatgacttcaccactagcatgggtatcgccgagggcaccgcctcgctgtttgtggactcctggcgggcggggaactgtccggccgctctggagcgtgagactgacccctgctccatgagccagctcaacaaggtgtgtgcagagacccactgctccatgctgctgaggacaggcacggtgttcgagaggtgccacgccacagtgaaccctgcacccttctacaagaggtgcgtgtaccaggcctgcaactacgaggagacctttccccacatctgtgccgccctgggcgactacgtacacgcctgctccttgcggggcgtcctgctctggggctggagaagcagtgtggacaactgcaccatcccctgcacgggtaacaccaccttcagctacaacagccaagcctgtgagcgcacctgcctgtcgctgtcggaccgtgccaccgagtgccaccacagcgccgtgcccgtggacggttgcaactgccccgatggcacctacctgaaccaaaagggcgagtgtgtgcgcaaggcccagtgcccgtgcatactggagggttacaagttcatcctggccgagcagtccactgtcatcaacggcatcacctgccactgcatcaacgggcggctgagttgcccgcagcggccacagatgttcctggcctcctgccaggcccctaagaccttcaagtcctgcagccagtcctccgagaacaagtttggggcagcctgtgcccccacatgccagatgctggccaccggtgttgcctgcgtgcccaccaagtgtgagcctggctgtgtctgcgccgagggcctctacgagaatgccgacgggcagtgtgtgccccccgaggagtgcccatgtgagttctcgggggtctcctaccctggaggagctgagctccacactgactgcaggacctgctcctgctcaagggggaggtgggcctgtcagcagggcacccactgcccatccacctgcaccctctacggggagggccacgtcatcaccttcgacggccagcgcttcgtattcgacggcaactgcgagtacatcctggccacggacgtctgtggtgtcaacgactcacagcccaccttcaagatcctgacagagaacgtcatctgtgggaactccggggtcacatgctcacgggccatcaagatcttcctggggggcctgtccgtggtgctggcggacagaaactacacggtcaccggggaggagccccacgtgcagctcggggtgacgccgggtgcgctgagccttgtcgtggacatcagcatccccgggaggtacaacctgacgctcatctggaacaggcacatgaccatcctcatcaggatcgcccgtgcctcccaggatcccctctgcggcttgtgtggcaacttcaacgggaacatgaaggacgacttcgagacgcgcagcaggtacgtggcatccagcgagctggagttggtgaactcgtggaaggagagcccgctgtgcggggacgtgagcttcgtgacagacccctgcagtctcaatgccttccggcgctcctgggccgagcgcaagtgcagcgtcatcaacagccagacctttgccacctgccacagcaaggtataccacctgccctactacgaggcctgcgtgcgcgacgcatgtgggtgtgacagtggcggggactgtgagtgtctgtgcgatgccgtggctgcctacgcccaagcctgtctggacaagggtgtgtgcgtggactggaggaccccggccttctgccccatctactgcggcttctacaacacgcacacgcaggacggccatggcgagtaccagtacacacaggaggccaactgcacgtggcactaccagccctgcctctgccccagccagccacagagcgtcccaggcagcaacatcgaaggctgctacaactgctcccaggatgagtacttcgaccacgaggagggggtgtgcgtgccctgcatgccgcccaccacgccgcagccacccaccacgccgcagctgcccaccacaggctcacggcccacgcaagtctggcccatgacgggaacctccaccaccatcgggcttctcagctccaccggaccctcacccagctctaatcacacccctgccagccccacccagacacccctccttccagccacgctcacatcctccaagcccacagcctcctcgggagaaccacctagaccaaccacggccgtcaccccacaagccacatcagggctgcctcccacagccacactgagatcgacagccacaaaacccacagtgacccaggccacaaccagggccacggcatcgaccgccagcccagccacgacgtccacagctcagtccacaacacggaccacaatgacactaccaaccccagccacatcagggacaagccccacgctgccaaaatcgaccaatcaggaactgccaggaacaacggccacccagacgacaggcccacgtccaaccccagcaagcaccacaggcccaaccaccccacagccaggacaacccacgaggcccacagccacagagaccactcaaacaagaacgactactgaatacacaacgccccaaaccccacacaccacacactccccgcctacggcggggagtcccgtcccttccacaggtcctgtcactgcaacatctttccatgccaccactacctatccaaccccatcacaccctgagaccacacttcccactcacgttccacctttctccacctccttggtgactccaagtactcacacagtcatcacccctacccacgcacagatggccacatctgcctccaaccactcagcgccaacaggtaccattcctccaccaacaacgctcaaggccacagggtccacccacacagccccaccaataacgccgaccaccagtgggaccagccaagcccacagctcattcagcacaaacaaaacacctacctcgctacattcacacacttcctccacacaccatcctgaagtcaccccaacttctactaccacgattactcccaaccccactagtacacgcaccagaacccctgtggcccacaccaactcagccaccagcagcaggccaccaccacccttcaccacacactccccacctacagggagcagtcccttctcttccacaggtcccatgacggcaacatccttcaagaccaccactacctatccaaccccatcactccctcagaccactcttctcactcacgttccacctttctcaacctctttggtgactccaattactcacacagtcatcacccctacccacccacagatgtccacttctgcctatatccactcaacgccaacaggcacgattgctccaccaacaacagttaaggccacaaggtccacctacacagccccactaatgacggcaaccaccagtaggatcagccaagcccacagctcaatcagcacagccaaaacctctacatccctccactcacatgcttcctccacacaccatcctgaagtcaccccaacttctaccaccaacgtgactcccaagtccaccagtagaggcaccagcacccctgtgacccacaccacctcggccaccagtagcaggccacccacacccatcacaacacactcttcacctaccaggagcagtcccctctcttccacaggtcgtatgactgcaacatctctcaagaccaccactacctatccaaccccatcacaagctcacatcacacttcccattcatgttccacctttctccacctcatcggtgactccaagtactcacacagtcatcaccccaacccacccacagatgtccacttctgcctccaaccactcaacgtcaacaggcaccattcctccactgacaacgctcaccaccacccttcaccacacactccccacctacagagagcagtcccctctctcccacaggtcctatgactccaacatccttcaagaccaccactacctatccaaccacatcacaccctcagaccacacttcccactcacgttccacctttctccagctcgtcagtgactccaagtactcacacagtcatcacccctacccatgcacagatgtccacttctgcctcgatccactcaacgccaacaggtaccattcctccactgacaacgctcacggccacagggtccacacacacagcctcaccaatgacggggacaaccattcggaccacccaagcccacagctcattcagcatagccaaaacctctacatccatcctctcacatgcttcctccacacaccatccggaaaccacaccaacttctaccaccaacattactcccaagtccactagtgcaggaaccagcacccctgtggcccacaccaccttggccaccagcagcaggccacccacacccttcaccacacactccccacctacagggagcagtcccatctcttccacaggtcctatgactgcaacatccatcaagaccaccacgacctatccaaccccatcacaccctcagaccacacttaccactcatgttccacctttctccacctcatcagtcactccaagtactcacacagtcatcacccctacccacgcacagatgtccacttcctccacacactatcctgaagtcaccccaacttctaccaccaccatcacccccaaccacaccagtacaggcaccagaacccctgtggcccacaccacctcggccaccagcagcaggctacccatacccttcaccacacattccccacctacagggagcagtcccatctcttccacaggtcctatgactgcaacatcctttcagaccaccactacctatccaaccccatcacaccctcagaccacacttcccactcaccttccacctttctccacctccttggtgactccaagtactcacacagtcatcatcactacccacacacagatggccacttctgcctccatccactcaacgccaacaggcaccgttcttccaccaacaacgctcaaggccacagggtccacccacacagcgccaacaatgacgccgaccaccagcgggacgagccaagccctgagctcattcaacacagccaaaacctctacatccctacattcacaaacttcctccacacaccttcctgaagtcaccccaacttctaccgccatcacccccaatcccaccagtacaggaaccggcacccctgtggcccacaccacctcagccaccagcagcaggctaaccacacccttcaccacacactccccacctacagggagcagtcccttctcttccacaggtcctatgactgcaacatccttccagaccaccactacctatccaacaccatcacaccctcagaccacacatcccactcacgttacatctttctccacctccttggtgactccaagtactcacacagtcatcacccctacccacgcacagatggccacttatgcgtccatccactcaacgccaacaggcaccatttctccaccaacaacgctcaaggccacagggtccttcccctcagccccaccaatgacgtcgaccaccagtgggaccagccaatcccgaagctcatttagcacggccaaaacctctacatccctacattcacacacttcctcaacacatcatcctgaagtcacctcaacttctaccaccagcatcacccccaaccacaccagtacaggcaccagaacccctgtggcccacaccacgtcggccaccagcagcaggctacccatacccttcaccacacactccccacctacagggagcagtcccatctcttccacaggtcctatgactgcaaacatccttccagaccaccactaccgatccaaccccatcacaccctcacaccacacttcccactcacgttccatctttctccacctccttggggactccaagtactcacatagtcatcacccctacccacgcacagatggccacttctgcctccatccactcaatgccaacaggcactattcctccaccgaccacgatcaaggccacagggtccacccacacagccccaccaatgacggcaaccaccagtgggaccagccaatccccaagctcatttagcacggccaaaacttctacatccctacattcacacatttcctcaacacatcatcctgaagtcaccccaacttctaccaccaccatcacccccaaccacaccagtacaggcaccagaacccctgtggcccacaccacctcggccaccagcagcaggctacccatacccttcaccacacattccccacctacagggagcagtcccatctcttccacaggtcctatgactgcaacatcctttcagaccaccactacctatccaaccccatcacaccctcacaccacacttcccactcacgttccatctttctccacctccttggtgactccaagtactcacatagtcatcacccctacccacgcacagatggccacttctgcctccatccactcaatgccaacaggcactattcctccaccgaccacgatcaaggccacagggtccacccacacagccccaccaatgacggcaaccaccagtgggaccagccaatccccaagctcatttagcacggcactgggcttctacatccctacattcacacattcctccacctacaacggtaaaggccacaggcacagggtccacgcacacagcaccacgaatgacagtgaccaccagcgggaccagccaagcgcacagctctttcagcacagccaaaacctccacatccctacactcacatgcttcttcaacactccatcctgaagtcaccccaacttctaccaccaccatcacccccaaccccaccaatacaggcatcagaacgcctgtggcaaacaccacctcagccaccagcagcaggctaaccacacccttcaccacacactccccacctacagggagcagtcccatctcttccacaggtcctatgactgcaacatccttccagaccaccactacatatccaaccccatcacaccctcagaccacacttcccactcacgttccacctttctccacctccttggtgactccaagtactcacacagtcatcacccctacccacgcacagatggccacttccgcctccatccattcaacgccaacaggcaccattcctccaccgacaacgctgaaggccacagggtccacccacacagccccaccaatgatgccaaccaccagtgggaccagccaagcctcaagctcattcaacacagccaaaacctctacatccctacattcacacacttcctccacacaccatcctgaagtcaccccaacttctatcaccaacatcaccctcaaccccaccagtataggaacctggacacccgtggcccacacaacctcagccaccagcagcaggctaaccacacccttcaccacacactccccacctacagggaccactcccatctcttccacaggacctgtcactgcaacatccttccatgccaccactacctatccaacaccatcacaccctcagaccacacttcccactcacgttccatctttctccacctccttggtgactccaagtactcacatagtcatcacccctacccacgcacagatggccacttctgcctccatccactcaatgcaaacaggcaccattcctccaccgaccacgatcaaggccacagggtccacccacacagccccaccaatgacaccgaccaccagtgggaccagccaatccctaagctcatttagcacggccaaaacttctacatccctaccttaccacacttcctccacacaccatcctgaagtcaccccaacttctaccaccaacatcacccccaaacacaccagtacaggcaccagaacccctgtggcccacaccacctcggccaccagcagcagactacccacacccttcaccacacattccccacctacagggagcagtcccatctcttccacaggtcctatgactgcaccatcctttcagaccaccactacctatccaaccccatcacaccctcagaccacacttcccactcacgttccacctttctccacctccttggtgactccaagtactcacacagtcatcacccctacccatgcacagatggccacttctgcctccatccactcaatgccaacaggcacgattcctccaccgacaacgctcaaggccacagggtccacccacacagcgccaacaatgacgccgaccaccagtgggaccagccaagccctgagctcattaaacacagccaaaacctctacatccctacattcacacacttcctccacacaccatgctgaagccacctcaacttctaccaccaacatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagaacccctgtggcccacaccacgtcggccaccagcagcaggctacccacacccttcaccacacactccccacctacagggaccactcccatctcttccacaggtcctgtcactgcaacatccttccagaccaccactacctatccaaccccatcacaccctcacaccacacttcccactcacgttccatctttctccacctccttggtgactccaagtactcacacggtcatcatccctacccacacacagatggccacttctgcctccatccactcaatgccaacaggcaccattcctccaccgaccacgatcaaggccacagggtccacccacacagccccaccaatgacaccgaccaccagtgggaccagccaatccccaagctcatttagcacggccaaaacttctacatccctaccttaccacacttcctcaacacaccatcctgaagtcaccccaacttctaccaccaacatcacccccaaacacaccagtacaggcaccagaacccctgtggcccacaccacctcggccagcagcagcaggctacccacacccttcaccacacactccccacctacagggagcagtcccttctcttccacaggtcctatgactgcaacatccttccagaccaccactacctatccaaccccatcacaccctcagaccacacttcccactcacgttccacctttctccacctccttggtgactccaagtactcacacagtcatcatcactacccacacacagatggccacttctgcctccatccactcaacgccaacaggcaccgttcctccaccaacaacgctcaaggccacagggtccacccacacagccccaccaatgacagtgaccaccagtgggaccagccaaacccacagctcattcagcacagctacagcctcttcttccttcatatcctcctcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccaccgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaaggcaca

SEQ ID NO: 155782 - DNA, 14829 bp, Homo sapiens
  Payload ID: 10600
  Gene Symbol: MUC6
  Gene Name: mucin 6, oligomeric mucus/gel-forming
  ENST ID: ENST00000627256
  CDS Start-End: 52-14194
ggcagcagcaggcctgccgggcccagcgcgagctcctctccactgtgcaccatggtccagcggtggctgctgctgtcctgctgcggagccctgctcagcgctggtctggctaacacctcctacaccagcccaggcctccagaggctgaaggactctccacagacagccccggacaaaggccagtgctccacgtggggggctggtcacttctccaccttcgaccaccacgtgtacgacttctcggggacgtgcaactacatcttcgcggccacctgcaaggacgccttccccaccttcagtgtccagctgcggcgaggcccagacgggagcatctcgcggatcatcgtggagctgggggcctccgtcgtcactgtgagcgaagccatcatctcagtcaaggacatcggggtcatcagcctgccctataccagcaatggactccagatcacacccttcggccagagcgtgcggctggtggccaagcagctggagctggagctggaagtcgtgtggggtcctgacagccacctcatggttctggtggagcggaagtacatgggtcagatgtgcgggctctgcgggaactttgacgggaaggtgaccaacgagtttgtcagtgaggagggcaagttcctggaaccccacaagtttgctgccctccagaagctggacgaccccggcgagatctgcaccttccaggacatccccagcacccacgtccggcaggcccagcacgcccggatctgcacccagctgctgaccctggtggcccctgagtgcagcgtgtccaaggagcccttcgtgctaagctgccaggcggacgtggccgcagccccccagccaggcccacagaacagcagttgtgccaccctgtcggagtactcccgccagtgcagcatggtgggccagccggtccgccgctggcggagccccggcctgtgctccgtgggtcagtgcccggccaaccaggtgtaccaggagtgcggctcggcctgcgtgaagacctgctccaacccgcagcacagctgctccagctcctgcaccttcgggtgcttctgcccggaaggtacggtcctgaatgacctctccaataaccacacctgcgtgcccgtcacccagtgcccctgtgtgctccacggcgccatgtatgcccccggggaggtcacaatagctgcctgccaaacctgccggtgcaccctgggccgctgggtgtgcacggagcggccgtgccccggacactgctccctggaaggtggctcctttgttaccacatttgacgccaggccctaccgcttccacggcacctgcacctacatcctcctccagagcccccagcttcccgaggacggtgccctcatggctgtgtacgacaagtccggcgtctcacactccgagacctccctggtggctgtggtctacctctccaggcaggacaaaattgtgatctctcaggacgaggtggtcaccaacaacggagaagccaagtggctgccatacaagactcgcaacatcacggtcttcaggcagacgtccacccacctccagatggccaccagcttcgggctggagctcgtggtccagctgcgccccatcttccaggcctatgtcactgttgggccccagttcagaggtcagaccagagggctctgcggcaacttcaacggggacacaacggatgacttcaccactagcatgggtatcgccgagggcaccgcctcgctgtttgtggactcctggcgggcggggaactgtccggccgctctggagcgtgagactgacccctgctccatgagccagctcaacaaggtgtgtgcagagacccactgctccatgctgctgaggacaggcacggtgttcgagaggtgccacgccacagtgaaccctgcacccttctacaagaggtgcatgtaccaggcctgcaactacgaggagacctttccccacatctgtgccgccctgggcgactacgtacacgcctgctccttgcggggcgtcctgctctggggctggagaagcagtgtggacaactgcaccatcccctgcacgggtaacaccaccttcagctacaacagccaagcctgtgagcgcacctgcctgtcgctgtcggaccgtgccaccgagtgccaccacagcgccgtgcccgtggacggttgcaactgccccgatggcacctacctgaaccaaaagggcgagtgtgtgcgcaaggcccagtgcccgtgcatactggagggttacaagttcatcctggccgagcagtccactgtcatcaacggcatcacctgccactgcatcaacgggcggctgagttgcccgcagcggccacagatgttcctggcctcctgccaggcccctaagaccttcaagtcctgcagccagtcctccgagaacaagtttggggcagcctgtgcccccacatgccagatgctggccaccggtgttgcctgcgtgcccaccaagtgtgagcctggctgtgtctgcgccgagggcctctacgagaatgccgacgggcagtgtgtgccccccgaggagtgcccatgtgagttctcgggggtctcctaccctggaggagctgagctccacactgactgcaggacctgctcctgctcaagggggaggtgggcctgtcagcagggcacccactgcccatccacctgcaccctctacggggagggccacgtcatcaccttcgacggccagcgcttcgtattcgacggcaactgcgagtacatcctggccacggacgtctgtggtgtcaacgactcacagcccaccttcaagatcctgacagagaacgtcatctgtgggaactccggggtcacatgctcacgggccatcaagatcttcctggggggcctgtccgtggtgctggcggacagaaactacacggtcaccggggaggagccccacgtgcagctcggggtgacgccgggtgcgctgagccttgtcgtggacatcagcatccccgggaggtacaacctgacgctcatctggaacaggcacatgaccatcctcatcaggatcgcccgtgcctcccaggatcccctctgcggcttgtgtggcaacttcaacgggaacatgaaggacgacttcgagacgcgcagcaggtacgtggcatccagcgagctggagttggtgaactcgtggaaggagagcccgctgtgcggggacgtgagcttcgtgacagacccctgcagtctcaatgccttccggcgctcctgggccgagcgcaagtgcagcgtcatcaacagccagacctttgccacctgccacagcaaggtataccacctgccctactacgaggcctgcgtgcgcgacgcatgtgggtgtgacagtggcggggactgtgagtgtctgtgcgatgccgtggctgcctacgcccaagcctgtctggacaagggtgtgtgcgtggactggaggaccccggccttctgccccatctactgcggcttctacaacacgcacacgcaggacggccatggcgagtaccagtacacacaggaggccaactgcacgtggcactaccagccctgcctctgccccagccagccacagagcgtcccaggcagcaacatcgaaggctgctacaactgctcccaggatgagtacttcgaccacgaggagggggtgtgcgtgccctgcatgccgcccaccacgccgcagccacccaccacgccgcagctgcccaccacaggctcacggcccacgcaagtctggcccatgacgggaacctccaccaccatcgggcttctcagctccaccggaccctcacccagctctaatcacacccctgccagccccacccagacacccctccttccagccacgctcacatcctccaagcccacagcctcctcgggagaaccacctagaccaaccacggccgtcaccccacaagccacatcagggctgcctcccacagccacactgagatcgacagccacaaaacccacagtgacccaggccacaaccagggccacggcatcgaccgccagcccagccacgacgtccacagctcagtccacaacacggaccacaatgacactaccaaccccagccacatcagggacaagccccacgctgccaaaatcgaccaatcaggaactgccaggaacaacggccacccagacgacaggcccacgtccaaccccagcaagcaccacaggcccaaccaccccacagccaggacaacccacgaggcccacagccacagagaccactcaaacaagaacgactactgaatacacaacgccccaaaccccacacaccacacactccccgcctacggcggggagtcccgtcccttccacaggtcctgtcactgcaacatctttccatgccaccactacctatccaaccccatcacaccctgagaccacacttcccactcacgttccacctttctccacctccttggtgactccaagtactcacacagtcatcacccctacccacgcacagatggccacatctgcctccatccactcagcgccaacaggtaccattcctccaccaacaacgctcaaggccacagggtccacccacacagccccaccaataacgccgaccaccagtgggaccagccaagcccacagctcattcagcacaaacaaaacacctacctcgctacattcacacacttcctccacacaccatcctgaagtcaccccaacttctactaccacgattactcccaaccccactagtacacgcaccagaacccctgtggcccacaccaactcagccaccagcagcaggccaccaccacccttcaccacacactccccacctacagggagcagtcccttctcttccacaggtcccatgacggcaacatccttcaagaccaccactacctatccaaccccatcactccctcagaccactcttctcactcacgttccacctttctcaacctctttggtgactccaattactcacacagtcatcacccctacccacccacagatgtccacttctgcctatatccactcaacgccaacaggcacgattgctccaccaacaacagttaaggccacaaggtccacctacacagccccactaatgacggcaaccaccagtaggatcagccaagcccacagctcaatcagcacagccaaaacctctacatccctccactcacatgcttcctccacacaccatcctgaagtcaccccaacttctaccaccaacgtgactcccaagtctaccagtagaggcaccagcacccctgtgacccacaccacctcggccaccagtagcaggccacccacacccatcacaacacactcttcacctaccaggagcagtcccctctcttccacaggtcgtatgactgcaacatctctcaagaccaccactacctatccaaccccatcacaagctcacatcacacttcccattcatgttccacctttctccacctcatcggtgactccaagtactcacacagtcatcaccccaacccacccacagatgtccacttctgcctccaaccactcaacgtcaacaggcaccattcctccactgacaacgctcatggccacagggtccacacacacagccccactaataacagtgaccaccagtaggaccagccaagtccacagctccttcagcacagccaaaacctctacatccctcctctcccatgcttcctccacacaccatccagaaatcaccacaaattctaccaccaccattactcccaaccccactagtacaggcaccggaacccctgtggcccacaccacctcagccaccagcagcaggccaccaccacccttcaccacacactccccacctacagagagcagtcccctctctcccacaggtcctatgactccaacatccttcaagaccaccactacctatccaaccacatcacaccctcagaccacacttcccactcacgttccacctttctccagctcgtcagtgactccaagtactcacacagtcatcacccctacccatgcacagatgtccacttctgcctcgatccactcaacgccaacaggtaccattcctccactgacaacgctcacggccacagggtccacacacacagcctcaccaatgacggggaccaccattcggaccacccaagcccacagctcattcagcatagccaaaacctctacatccatcctctcacatgcttcctccacacaccatccggaaaccacaccaacttctaccaccaacattactcccaagtccactagtgcaggaaccagcacccctgtggcccacaccaccttggccaccagcagcaggccacccacacccttcaccacacactccccacctacagggagcagtcccatctcttccacaggtcctatgactgcaacatccatcaagaccaccacgacctatccaaccccatcacaccctcagaccacacttaccactcatgttccacctttctccacctcatcagtcactccaagtactcacacagtcatcacccctacccacgcacaaatgtccacttctgcttcgatccactcaacgccaacaggcaccgttcctccactgacaacgcgcatgcccacagggtcgacacacacaggcccaccaatgacggggaccattattcagacaagcaaagctcacaactcattcagcacagccaaaacttctacatctctccactcacatgcttcctccacacaccatcctgaaaccacaccaacttctaccaccaacattactcccaagcccactagtgcaggaaccagcacccctgtggcccacactaccttggccaccagcagcaggctacctacaaccttcaccacacacttcccatctacagggagcagtcctgtctcttccacaggtcctatgactgcaacatcctcccagaccaccactacctatccaaccccatcacaccctcagaccactcttcccactcacattccacctttctccacctccttggtgactccaagtactcacacagtcatcacccctacccgcgcacaaatgtccacttctgcctccatccactcaacgccaacaggcaccattcctccacctacaacgctaaaggccacaggcaccacccacacgcacacaacaaggacaatgacagtgaccaccaccagccaagccctgaggtcattatatatcggcacagcctctacatccatacctttacactcacatgcttcatcccatctccgaacctgacgtcacttctactactaacatcaccatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagaacccctgtggcccacaccacgtcggccaccagcagcaggctacccacacccttcaccacacactccccacctacagggaccactcccatctcttccacaggtcctgtcactgcaacatccttccagaccaccactaccgatccaaccccatcacaccctcacaccacacttcccactcacgttccatctttctccacctccttggtgactccaagtactcacatagtcatcacccctacccacgcacagatggccacttctgcctccatccactcaatgccaacaggcactattcctccaccgaccacgatcaaggccacagggtccacccacacagccccaccaatgacggcaaccaccagtgggaccagccaatccccaagctcatttagcacggccaaaacttctacatccctacattcacacatttcctcaacacatcatcctgaagtcaccccaacttctaccaccaccatcacccccaaccacaccagtacaggcaccagaacccctgtggcccacaccacctcggccaccagcagcaggctacccatacccttcaccacacattccccacctacagggagcagtcccatctcttccacaggtcctatgactgcaacatcctttcagaccaccactacctatccaaccccatcacaccctcagaccacacttcccactcacattccacctttctccacctccttggtgactccaagtactcacacagtcatcatcactacccacacacagatggccacttctgcctccatccactcaacgccaacaggcaccgttcctccaccaacaacgctcaaggccacagggtccacccacacagcgccaacaatgacgccgaccaccagcgggacgagccaagccctgagctcattcaacacagccaaaacctctacatccctacattcacaaacttcctccacacaccttcctgaagtcaccccaacttctaccgccatcacccccaatcccaccagtccaggaaccggcacccctgtggcccacaccacctcagccaccagcagcaggctaaccacacccttcaccacacactcctcacctacagggagcagtcccttctcttccacaggtcctatgactgcaacatccttccagaccaccactacctatccaaccccatcacaccctcagaccacacttcccactcacgttccacctttctccacctctttggtgactccaagtactcacacagtcatcacccctacccatgcacagatggccacttctgcctccatccactcaatgccaacaggcacgattcctccaccgacaacgctcaaggccacagggtccacccacacagcgccaacaatgacgctgaccaccagcgggaccagccaagccctgagctcattaaacacagccaaaacctctacatccctacattcacacacttcctccacacaccatgctgaagccacctcaacttctaccaccaacatcacccccaaccccaccagtacaggaactggggcgcgtgtggcccacaccacctcagccaccagcagcaggctaaccccgcccttcaccacacactccccacctacagggtaacaacgctcaaggccacagggtccatccacacagccccaccaatgacgccgaccaccagtgggaccagccaatccccaagctcatttagcatggccaaaacttctacatccctaccttaccacacttcctccacacaccatcctgaagtcaccccaacttctaccaccaacatcacccccaaacacaccagtacaggcacaagaacccctgtggcccacaccacctcggccaccagcagcaagctacccacacccttcaccacacactccccacctacaggaagcagtcccatctcttccacaggtcctgtcactgcaacatccttccagaccaccactacctatccaaccccatcacactctcacaccacacttcccactcacgttccaccttcctccacctccttggtgactccaaatactcacacagtcatcacccatacccatgcacagatgtccacttctgcctccatccactcaacgccaacaggcaccattcctccaccgacaacgctcaaggccacagggtccacccacacagccccaccaatgacgccgaccaccagtgggaccaggcaagccccaagctcattcagcacagccaaaacttctacatccctacattcacacacttcctccacacaccatcctgcagtcaccccaacttctaccaccaccatcacccccaaccacaccagtacaggcaccaggacccctgtggcccacaccacttcggccaccagcagcaggctacccacacccttcaccacacactccccaccgacagggagcagtcccatctcttccacagctccctgtcactgcaacatccttccagaccaccactaccctatccaacccacatcacagtctcagtaccacacttcccactcacattccacctttctccacctccttggtgactccaagtacacacacagtcatcaccccaacttctaccaccatcacccccaatcccaccagtacagaaaccgtcacccctgtggcccacaccacctcagccaccagcagcaggctaaccacacccttcaccacacactccccacctacagggagcagtcccatctcttccacaggtcctgtcactgcaacatccttccatgccaccactacctatccaacaccatcacaccctcagaccacacttcccactcacgttccatctttctccacctccttggtgactccaagtactcacacagtcatcacccctacccacgcacagatgaccacttctgcctccatccactcaatgccaacaggcaccattcctccaccgacaacgctgaaggccacagggtccacccacacagccccaccaatgatgccaaccaccagtgggaccagccaagcctcaagctcattcaacacagccaaaacctctacatccctacattcacacacttcctccacacaccatcctgaagtcaccccaacttctatcaccaacatcaccctcaaccccaccagtataggaacctggacacccgtggcccacaccacctcagccaccagcagcaggctaaccacacccttcaccacacactccccacctacagggaccactcccatctcttccacaggtcctgtcactgcaacatccttccatgccaccactacctatccaacaccatcacaccctcagaccacacttcccactcacgttccatctttctccacctccttggtgactccaagtactcacatagtcatcacccctacccacgcacagatggccacttctgcctccatccactcaatgcaaacaggcaccattcctccaccgaccacgatcaaggccacagggtccacccacacagccccaccaatgacaccgaccaccagtgggaccagccaatccctaagctcatttagcacggccaaaacttctacatccctaccttaccacacttcctccacacaccatcctgaagtcaccccaacttctaccaccaacatcacccccaaacacaccagtacaggcaccagaacccctgtggcccacaccacctcggccaccagcagcagactacccacacccttcaccacacattccccacctacagggagcagtcccatctcttccacaggtcctatgactgcaccatcctttcagaccaccactacctatccaaccccatcacaccctcagaccacacttcccactcacattccacctttctccacctccttggtgactccaagtactcacaaggtcatcacccctacccatgcacagatgtccacttctgcctccatccactcaacgccaacaggcaccattcctccactaacaacgctcaaggtcacagggtccacccacacagccccaccaatcacagtgaccaccagtgggaccagcccatccgcaagctcatttagcacaggcaaaacctctacatccttacattcacacacttcctccacacactatcctgaagtcaccccaacttctaccaccaccatcacccccaaccacaccagtacaggcaccagaacccctgtggcccacaccacctcggccaccagcagcaggctacccatacccttcaccacacattccccacctacagggagcagtcccatctcttccacaggtcctatgactgcaacatccttccagaccaccactacctatccaaccccatcacaccctcagaccacacttcccactcacgttccacctttctccacctctttggtgactccaagtactcacacagtcatcacccctacccatgcacagatggccacttctgcctccatccactcaatgccaacaggcacgattcctccaccgacaacgctcaaggccacagggtccacccacacagcgccaacaatgacgctgaccaccagcgggaccagccaagccctgagctcattaaacacagccaaaacctctacatccctacattcacacacttcctccacacaccatgctgaagccacctcaacttctaccaccaacatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagaacccctgtggcccacaccacgtcggccaccagcagcaggctacccacacccttcaccacacactccccacctacagggaccactcccatctcttccacaggtcctgtcactgcaacatccttccagaccaccactacctatccaaccccatcacaccctcacaccacacttcccactcacgttccatctttctccacctccttggtgactccaagtactcacacggtcatcatccctacccacacacagatggccacttctgcctccatccactcaatgccaacaggcaccattcctccaccgaccacgatcaaggccacagggtccacccacacagccccaccaatgacaccgaccaccagtgggaccagccaatccccaagctcatttagcacggccaaaacttctacatccctaccttaccacacttcctcaacacaccatcctgaagtcaccccaacttctaccaccaacatcacccccaaacacaccagtacaggcaccagaacccctgtggcccacaccacctcggccagcagcagcaggctacccacacccttcaccacacactccccacctacagggagcagtcccttctcttccacaggtcctatgactgcaacatccttccagaccaccactacctatccaaccccatcacaccctcagaccacacttcccactcacgttccacctttctccacctccttggtgactccaagtactcacacagtcatcatcactacccacacacagatggccacttctgcctccatccactcaacgccaacaggcaccgttcctccaccaacaacgctcaaggccacagggtccacccacacagccccaccaatgacagtgaccaccagtgggaccagccaaacccacagctcattcagcacagctacagcctcttcttccttcatatcctcctcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactgcatcagtgtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccactgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaaggcaca

SEQ ID NO: 155783 - DNA, 2443 bp, Homo sapiens
  Payload ID: 10601
  Gene Symbol: MUC7
  Gene Name: mucin 7, secreted
  Uniprot ID: Q8TAX7
  ENST ID: ENST00000304887
  CDS Start-End: 191-1324
ttatcttaaatctaatagatttcctatttccaaaaagctcgactggagtgttataaaacctgaaaattctcttgtgctttctcttcttttgcttctagttaccatcctcaaaggattggctaaaagcaagcaactggattgaacaccctaagaagaaagattcacactgcaccaggagacatcagaaagaatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgccaccaccatatcttcaagagaaaatgttaacacaagctcttctgtagctacattagcaccagtgaattccccagctccacaagacaccacagctgccccacccacaccttctgcaactacaccagctccaccatcttcctcagctccaccagagaccacagctgccccacccacaccttctgcaactacacaagctccaccatcttcctcagctccaccagagaccacagctgccccacccacacctcctgcaactacaccagctccaccatcttcctcagctccaccagagaccacagctgccccacccacaccttctgcaactacaccagctccactatcttcctcagctccaccagagaccacagctgtcccacccacaccttctgcaactaccctagacccatcatccgcctcagctccaccagagaccacagctgccccacccacaccttctgcaactacaccagctccaccgtcttccccagctccacaagagaccacagctgccccaattaccacacctaattcttccccaactactcttgcacctgacacttctgaaacttcagctgcacccacacaccagactactacttcggtcactactcaaactactactactaaacaaccaacttcagctcctggccaaaataaaatttctcgatttcttttatatatgaagaatctactaaacagaattattgacgacatggtggagcaatagtatattgtatgttgtaaagtgttctgtcatttacaagatgtgattcatgagtgcagaactaccacctttcttttagcaccaatcccaacatgaaattatattactcagatttaaagcactatcattaatctttcaatctaattattcaccaccacaagacctattaacaagacaaaatgcctctatcccacaagccagatgcaggtctggggttcaaaataactctttggatcctacagagatagcctactgagggcaaagaaagtccttagataaagagagaatattgtatgggccatcaaccatttacttttccctgaatgttagaaactacaaaaccactaccttgtacccccatcaaaatcccacctgaaccatctaatcctataaacataaaggggtaaaattggaactctccagatgaacaaagacatctaaatatctgtagatagaaacatttatctatctaaatatattgatagacctgtcattgtattgattaatgacaaaaccctttagataattatcttccattttaaataaaattttatttcacaaatatgagccaagaaagaggaaagttgatttgaagtgaggattagaagtgaatgacaataaagtctgtcagccaagcacgaaccaagactggcactatttttcttagtgtatataattgtttaaactgcaaggttgacatttattgtgttgtgtctaagttaatttcgatctaatgtacctgattctagcctctgtgaacaacaagaatatgtttgtgtatgttcacatggtgcttataatatttcactatcaattcaattaattcacataaattccatgtgaaatgtattcaacaatggaatattttctaaaacatttagtatacatttgaatgtattttaaaccatgccaaactactgctttaatgtcaagtttgcagaattgtctctgaaaataaaaaccctgactttagttgtaaaacaataaaagttagctacttggtatacggagatgttaatttgggatatggaggcatttttatcttctgtcactactacttaaaactctgatgattatgttagatttttttgctaactaataaagatttcaaatggcaattta

SEQ ID NO: 155784 - DNA, 2479 bp, Homo sapiens
  Payload ID: 10601
  Gene Symbol: MUC7
  Gene Name: mucin 7, secreted
  Uniprot ID: Q8TAX7
  ENST ID: ENST00000456088
  CDS Start-End: 228-1361
actgttccactactcatcaagcacataagttactcattgagaacctctgatcgtcactgtgctcatcaggaagaaattgatgcacaaagaactactgtcaatctcagcaaaccacaactattcttttctttaaaattaccatcctcaaaggattggctaaaagcaagcaactggattgaacaccctaagaagaaagattcacactgcaccaggagacatcagaaagaatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgccaccaccatatcttcaagagaaaatgttaacacaagctcttctgtagctacattagcaccagtgaattccccagctccacaagacaccacagctgccccacccacaccttctgcaactacaccagctccaccatcttcctcagctccaccagagaccacagctgccccacccacaccttctgcaactacacaagctccaccatcttcctcagctccaccagagaccacagctgccccacccacacctcctgcaactacaccagctccaccatcttcctcagctccaccagagaccacagctgccccacccacaccttctgcaactacaccagctccactatcttcctcagctccaccagagaccacagctgtcccacccacaccttctgcaactaccctagacccatcatccgcctcagctccaccagagaccacagctgccccacccacaccttctgcaactacaccagctccaccgtcttccccagctccacaagagaccacagctgccccaattaccacacctaattcttccccaactactcttgcacctgacacttctgaaacttcagctgcacccacacaccagactactacttcggtcactactcaaactactactactaaacaaccaacttcagctcctggccaaaataaaatttctcgatttcttttatatatgaagaatctactaaacagaattattgacgacatggtggagcaatagtatattgtatgttgtaaagtgttctgtcatttacaagatgtgattcatgagtgcagaactaccacctttcttttagcaccaatcccaacatgaaattatattactcagatttaaagcactatcattaatctttcaatctaattattcaccaccacaagacctattaacaagacaaaatgcctctatcccacaagccagatgcaggtctggggttcaaaataactctttggatcctacagagatagcctactgagggcaaagaaagtccttagataaagagagaatattgtatgggccatcaaccatttacttttccctgaatgttagaaactacaaaaccactaccttgtacccccatcaaaatcccacctgaaccatctaatcctataaacataaaggggtaaaattggaactctccagatgaacaaagacatctaaatatctgtagatagaaacatttatctatctaaatatattgatagacctgtcattgtattgattaatgacaaaaccctttagataattatcttccattttaaataaaattttatttcacaaatatgagccaagaaagaggaaagttgatttgaagtgaggattagaagtgaatgacaataaagtctgtcagccaagcacgaaccaagactggcactatttttcttagtgtatataattgtttaaactgcaaggttgacatttattgtgttgtgtctaagttaatttcgatctaatgtacctgattctagcctctgtgaacaacaagaatatgtttgtgtatgttcacatggtgcttataatatttcactatcaattcaattaattcacataaattccatgtgaaatgtattcaacaatggaatattttctaaaacatttagtatacatttgaatgtattttaaaccatgccaaactactgctttaatgtcaagtttgcagaattgtctctgaaaataaaaaccctgactttagttgtaaaacaataaaagttagctacttggtatacggagatgttaatttgggatatggaggcatttttatcttctgtcactactacttaaaactctgatgattatgttagatttttttgctaactaataaagatttcaaatggcaattt

SEQ ID NO: 155785 - DNA, 2540 bp, Homo sapiens
  Payload ID: 10601
  Gene Symbol: MUC7
  Gene Name: mucin 7, secreted
  Uniprot ID: Q8TAX7
  ENST ID: ENST00000413702
  CDS Start-End: 289-1422
actcaattacagtatttcctattcctaaaagaatctagtaggaaggctataagaaatgttctcttactgatccttcttatttgccaccttagattttaagttgcttcttggctaccaaaatgcctagacacagtaactaacaagaattcaactgacaagtagtttgaccagacttggaggaaggattccttcaaagttaccatcctcaaaggattggctaaaagcaagcaactggattgaacaccctaagaagaaagattcacactgcaccaggagacatcagaaagaatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgccaccaccatatcttcaagagaaaatgttaacacaagctcttctgtagctacattagcaccagtgaattccccagctccacaagacaccacagctgccccacccacaccttctgcaactacaccagctccaccatcttcctcagctccaccagagaccacagctgccccacccacaccttctgcaactacacaagctccaccatcttcctcagctccaccagagaccacagctgccccacccacacctcctgcaactacaccagctccaccatcttcctcagctccaccagagaccacagctgccccacccacaccttctgcaactacaccagctccactatcttcctcagctccaccagagaccacagctgtcccacccacaccttctgcaactaccctagacccatcatccgcctcagctccaccagagaccacagctgccccacccacaccttctgcaactacaccagctccaccgtcttccccagctccacaagagaccacagctgccccaattaccacacctaattcttccccaactactcttgcacctgacacttctgaaacttcagctgcacccacacaccagactactacttcggtcactactcaaactactactactaaacaaccaacttcagctcctggccaaaataaaatttctcgatttcttttatatatgaagaatctactaaacagaattattgacgacatggtggagcaatagtatattgtatgttgtaaagtgttctgtcatttacaagatgtgattcatgagtgcagaactaccacctttcttttagcaccaatcccaacatgaaattatattactcagatttaaagcactatcattaatctttcaatctaattattcaccaccacaagacctattaacaagacaaaatgcctctatcccacaagccagatgcaggtctggggttcaaaataactctttggatcctacagagatagcctactgagggcaaagaaagtccttagataaagagagaatattgtatgggccatcaaccatttacttttccctgaatgttagaaactacaaaaccactaccttgtacccccatcaaaatcccacctgaaccatctaatcctataaacataaaggggtaaaattggaactctccagatgaacaaagacatctaaatatctgtagatagaaacatttatctatctaaatatattgatagacctgtcattgtattgattaatgacaaaaccctttagataattatcttccattttaaataaaattttatttcacaaatatgagccaagaaagaggaaagttgatttgaagtgaggattagaagtgaatgacaataaagtctgtcagccaagcacgaaccaagactggcactatttttcttagtgtatataattgtttaaactgcaaggttgacatttattgtgttgtgtctaagttaatttcgatctaatgtacctgattctagcctctgtgaacaacaagaatatgtttgtgtatgttcacatggtgcttataatatttcactatcaattcaattaattcacataaattccatgtgaaatgtattcaacaatggaatattttctaaaacatttagtatacatttgaatgtattttaaaccatgccaaactactgctttaatgtcaagtttgcagaattgtctctgaaaataaaaaccctgactttagttgtaaaacaataaaagttagctacttggtatacggagatgttaatttgggatatggaggcatttttatcttctgtcactactacttaaaactctgatgattatgttagatttttttgctaactaataaagatttcaaatggcaattt

SEQ ID NO: 155786 - DNA, 635 bp, Homo sapiens
  Payload ID: 10601
  Gene Symbol: MUC7
  Gene Name: mucin 7, secreted
  ENST ID: ENST00000505411
  CDS Start-End: 228-635
actgttccactactcatcaagcacataagttactcattgagaacctctgatcgtcactgtgctcatcaggaagaaattgatgcacaaagaactactgtcaatctcagcaaaccacaactattcttttctttaaaattaccatcctcaaaggattggctaaaagcaagcaactggattgaacaccctaagaagaaagattcacactgcaccaggagacatcagaaagaatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgcc

SEQ ID NO: 155787 - DNA, 470 bp, Homo sapiens
  Payload ID: 10602
  Gene Symbol: MUCL1
  Gene Name: mucin-like 1
  Uniprot ID: Q96DR8
  ENST ID: ENST00000308796
  CDS Start-End: 47-319
ctttgaagcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcaaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacataaaaa

SEQ ID NO: 155788 - DNA, 439 bp, Homo sapiens
  Payload ID: 10602
  Gene Symbol: MUCL1
  Gene Name: mucin-like 1
  ENST ID: ENST00000546809
  CDS Start-End: 37-294
atttactggattgaacagttcaggcttctggccagtatgggaggtgaccatgggtatcaactggcagtgactaaagcagagaatccgacaacagctgctccagctgacacgtatccagctactggtcctgctgatgatgaagcccctgatgctgaaaccactgctgctgcaaccactgcaaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaaca

SEQ ID NO: 155789 - DNA, 243 bp, Homo sapiens
  Payload ID: 10602
  Gene Symbol: MUCL1
  Gene Name: mucin-like 1
  ENST ID: ENST00000619042
  CDS Start-End: 1-243
atgaagttcttagcagtcctggtactcttgggagtttccatctttctggtctctgcccagaatccgacaacagctgctccagctgacacgtatccagctactggtcctgctgatgatgaagcccctgatgctgaaaccactcctaccactgcaaccaccgctgcttctaccactgctcgtaaagacattccagttttacccaaatgggttggggatctcccgaatggtagagtgtgtccctga

SEQ ID NO: 155790 - DNA, 2082 bp, Homo sapiens
  Payload ID: 10603
  Gene Symbol: MCOLN1
  Gene Name: mucolipin 1
  Uniprot ID: Q9GZU1
  ENST ID: ENST00000264079
  CDS Start-End: 126-1868
agatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaatgtgtcgttttcattttta

SEQ ID NO: 155791 - DNA, 666 bp, Homo sapiens
  Payload ID: 10603
  Gene Symbol: MCOLN1
  Gene Name: mucolipin 1
  ENST ID: ENST00000601003
  CDS Start-End: 65-666
cggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactggctggtcaatgtcaccatccacttccggctg

SEQ ID NO: 155792 - DNA, 666 bp, Homo sapiens
  Payload ID: 10603
  Gene Symbol: MCOLN1
  Gene Name: mucolipin 1
  ENST ID: ENST00000599334
  CDS Start-End: 1-548
tcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 155793 - DNA, 1729 bp, Homo sapiens
  Payload ID: 10604
  Gene Symbol: MCOLN2
  Gene Name: mucolipin 2
  Uniprot ID: Q8IZK6
  ENST ID: ENST00000284027
  CDS Start-End: 113-1729
cacagagccgcctttcagccgcccgagaactgcccgccgcactccacgactgcggcgcctgctctcgggccggggtctgcgcgcaccacgcggccggcagaaaggaaatgcaatggcacatcgtgattctgagatgaaagaagaatgtctaagggaagacctgaagttttacttcatgagcccttgtgaaaaataccgagccagacgccagattccgtggaaactgggtttgcagattttgaagatagtcatggtcaccacacagcttgttcgttttggtttaagtaaccagctggtggttgctttcaaagaagataacactgttgcttttaagcacttgtttttgaaaggatattctggtacagatgaagatgactacagctgcagtgtatatactcaagaggatgcctatgagagcatcttttttgctattaatcagtatcatcagctaaaggacattaccctggggacccttggttatggagaaaatgaagacaatagaattggcttaaaagtctgtaagcagcattacaagaaagggaccatgtttccttctaatgagacactgaatattgacaacgacgttgagctcgattgtgttcaattagaccttcaggacctctccaagaagcctccggactggaagaactcatcattcttcagactggaattttatcggctcttacaggttgaaatctcctttcatcttaaaggcattgacctacagacaattcattcccgtgagttaccagactgttatgtctttcagaatacgattatctttgacaataaagctcacagtggcaaaatcaaaatctattttgacagtgatgccaaaattgaagaatgtaaagacttgaacatatttggatctactcagaaaaatgctcagtatgtcctggtgtttgatgcatttgtcattgtgatttgcttggcatctcttattctgtgtacaagatccattgttcttgctctaaggttacggaagagatttctaaatttcttcctggagaagtacaagcggcctgtgtgtgacaccgaccagtgggagttcatcaacggctggtatgtcctggtgattatcagcgacctaatgacaatcattggctccatattaaaaatggaaatcaaagcaaagaatctcacaaactatgatctctgcagcatttttcttggaacctctacgctcttggtttgggttggagtcatcagatacctgggttatttccaggcatataatgtgctgattttaacaatgcaggcctcactgccaaaagttcttcggttttgtgcttgtgctggtatgatttatctgggttacacattctgtggctggattgtcttaggaccataccatgacaagtttgaaaatctgaacacagttgctgagtgtctgttttctctggtcaacggtgatgacatgtttgcaacctttgcccaaatccagcagaagagcatcttggtgtggctgttcagtcgtctgtatttatattccttcatcagcctttttatatatatgattctcagtctttttattgcacttattacagattcttatgacaccattaagaaattccaacagaatgggtttcctgaaacggatttgcaggaattcctgaaggaatgcagtagcaaagaagagtatcagaaagagtcctcagccttcctgtcctgcatctgctgtcggaggaggaaaagaagtgatgatcacttgatacctattagctaa

SEQ ID NO: 155794 - DNA, 2871 bp, Homo sapiens
  Payload ID: 10604
  Gene Symbol: MCOLN2
  Gene Name: mucolipin 2
  Uniprot ID: Q8IZK6
  ENST ID: ENST00000370608
  CDS Start-End: 69-1769
gagtcggccgtgaacggtgtttcctgttccgaatcccgagagccctggaaagttttgaaggaggaggcatggcccggcagccttatcgttttccccaggcaaggattccggagagaggatcaggtgttttcaggttaaccgtcagaaatgcaatggcacatcgtgattctgagatgaaagaagaatgtctaagggaagacctgaagttttacttcatgagcccttgtgaaaaataccgagccagacgccagattccgtggaaactgggtttgcagattttgaagatagtcatggtcaccacacagcttgttcgttttggtttaagtaaccagctggtggttgctttcaaagaagataacactgttgcttttaagcacttgtttttgaaaggatattctggtacagatgaagatgactacagctgcagtgtatatactcaagaggatgcctatgagagcatcttttttgctattaatcagtatcatcagctaaaggacattaccctggggacccttggttatggagaaaatgaagacaatagaattggcttaaaagtctgtaagcagcattacaagaaagggaccatgtttccttctaatgagacactgaatattgacaacgacgttgagctcgattgtgttcaattagaccttcaggacctctccaagaagcctccggactggaagaactcatcattcttcagactggaattttatcggctcttacaggttgaaatctcctttcatcttaaaggcattgacctacagacaattcattcccgtgagttaccagactgttatgtctttcagaatacgattatctttgacaataaagctcacagtggcaaaatcaaaatctattttgacagtgatgccaaaattgaagaatgtaaagacttgaacatatttggatctactcagaaaaatgctcagtatgtcctggtgtttgatgcatttgtcattgtgatttgcttggcatctcttattctgtgtacaagatccattgttcttgctctaaggttacggaagagatttctaaatttcttcctggagaagtacaagcggcctgtgtgtgacaccgaccagtgggagttcatcaacggctggtatgtcctggtgattatcagcgacctaatgacaatcattggctccatattaaaaatggaaatcaaagcaaagaatctcacaaactatgatctctgcagcatttttcttggaacctctacgctcttggtttgggttggagtcatcagatacctgggttatttccaggcatataatgtgctgattttaacaatgcaggcctcactgccaaaagttcttcggttttgtgcttgtgctggtatgatttatctgggttacacattctgtggctggattgtcttaggaccataccatgacaagtttgaaaatctgaacacagttgctgagtgtctgttttctctggtcaacggtgatgacatgtttgcaacctttgcccaaatccagcagaagagcatcttggtgtggctgttcagtcgtctgtatttatattccttcatcagcctttttatatatatgattctcagtctttttattgcacttattacagattcttatgacaccattaagaaattccaacagaatgggtttcctgaaacggatttgcaggaattcctgaaggaatgcagtagcaaagaagagtatcagaaagagtcctcagccttcctgtcctgcatctgctgtcggaggaggaaaagaagtgatgatcacttgatacctattagctaaagttctgctaaagatgattaaagttcaggcatccttatccagcggctgagcagaggaaccccaaatgacttggacaagcagttccaaaatgactctcttatttaattgtggagtgggaaagaggactcacagttagccagctgaccatgactgaagttccagctttactttttataaacttgaatgataaagaatagaccatgggctactactgggcattagtgcaatataacagcgataataaaattctctattagtctgttaatttatgacatgatctcggaatggaaaaagatcatttcagagtgtgcgaaataatagtctttaaccatgtaattaaatatgtgtgtttattgtcaaataaggatttgttttaaaggtgattcttgggtttgaagacatttgttaattcatggtctgtacagaaatgaagctggttgcaataccaatctagagagtccaagctggtgaactattaagctgtttaaagatcacccttggcctggcacagtggttcacacctgtaatcccagcactttgggaggcctaggcaggcagactgagctcaggagcttgagaccagcctgggcaacatggcaaaaacccacctctacaaaaagtacaaaaattagtcgggcgtgatggcaggcatctgtagtcccagctacttgggaagctgaagtgggaggatcacctgagctctggaggtggaggctgccatgagccatgatcgtgccactacactccagcctgggtgacagagtgagatcctgtctcaaaaaaaaaaaaaaatcacccttaaatcaacaaaaagacctcatgctcatgcagtggacatttcttggcctgttttcctgtgggttttcttcagcatgatatgaagcaactgttggcatagccagtgggataaataagaaatggaatcatttggctgcctcgtcacttgtgctaatggtcagttgtacacacatgacatgtggaagtgacctgtagcagcggtcactcattttaacaattgaactctgctgggttgggtatttacctttgtctagaaaagaaatatgatatattttctctaaataaatttattttcatcattcca

SEQ ID NO: 155795 - DNA, 2403 bp, Homo sapiens
  Payload ID: 10604
  Gene Symbol: MCOLN2
  Gene Name: mucolipin 2
  ENST ID: ENST00000463065
  CDS Start-End: 242-991
acacagagccgcctttcagccgcccgagaactgcccgccgcactccacgactgcggcgcctgctctcgggccggggtctgcgcgcaccacgcggccggcagaaagggtaagagaagggaaccccgctttgcagggctccaacttcggcggacgcgttacggcgagggcgaaatgagtcggccgtgaacggtgtttcctgttccgaatcccgagagccctggaaagttttgaaggaggaggcatggcccggcagccttatcgttttccccaggcaaggattccggagagaggatcaggtgttttcaggttaaccgtcagaaatgcaatggcacatcgtgattctgagatgaaagaagaatgtctaagggaagacctgaagttttacttcatgagcccttgtgaaaaataccgagccagacgccagattccgtggaaactgggtttgcagattttgaagatagtcatggtcaccacacagcttgttcgttttggtttaagtaaccagctggtggttgctttcaaagaagataacactgttgcttttaagcacttgtttttgaaaggatattctggtacagatgaagatgactacagctgcagtgtatatactcaagaggatgcctatgagagcatcttttttgctattaatcagtatcatcagctaaaggacattaccctggggacccttggttatggagaaaatgaagacaatagaattggcttaaaagtctgtaagcagcattacaagaaagggaccatgtttccttctaatgagacactgaatattgacaacgacgttgagctcgattgtgttcaattagaccttcaggacctctccaagaagcctccggactggaagaactcatcattcttcagactggaattttatcggctcttacaggttgaaatctcctttcatcttaaaggcattgacctacagacaattcattcccgtgagttaccagactgttatgtctttcagaatacgtgatgccaaaattgaagaatgtaaagacttgaacatatttggatctaaatctcacaaactatgatctctgcagcatttttcttggaacctctacgctcttggtttgggttggagtcatcagatacctgggttatttccaggcatataatgtgctgattttaacaatgcaggcctcactgccaaaagttcttcggttttgtgcttgtgctggtatgatttatctgggttacacattctgtggctggattgtcttaggaccataccatgacaagtttgaaaatctgaacacagttgctgagtgtctgttttctctggtcaacggtgatgacatgtttgcaacctttgcccaaatccagcagaagagcatcttggtgtggctgttcagtcgtctgtatttatattccttcatcagcctttttatatatatgattctcagtctttttattgcacttattacagattcttatgacaccattaagaaattccaacagaatgggtttcctgaaacggatttgcaggaattcctgaaggaatgcagtagcaaagaagagtatcagaaagagtcctcagccttcctgtcctgcatctgctgtcggaggaggaaaagaagtgatgatcacttgatacctattagctaaagttctgctaaagatgattaaagttcaggcatccttatccagcggctgagcagaggaaccccaaatgacttggacaagcagttccaaaatgactctcttatttaattgtggagtgggaaagaggactcacagttagccagctgaccatgactgaagttccagctttactttttataaacttgaatgataaagaatagaccatgggctactactgggcattagtgcaatataacagcgataataaaattctctattagtctgttaatttatgacatgatctcggaatggaaaaagatcatttcagagtgtgcgaaataatagtctttaaccatgtaattaaatatgtgtgtttattgtcaaataaggatttgttttaaaggtgattcttgggtttgaagacatttgttaattcatggtctgtacagaaatgaagctggttgcaataccaatctagagagtccaagctggtgaactattaagctgtttaaagatcacccttggcctggcacagtggttcacacctgtaatcccagcactttgggaggcctaggcaggcagactgagctcaggagcttgagaccagcctgggcaacatggcaaaaacccacctctacaaaaagtacaaaaattagtcgggcgtgatggcaggcatctgtagtcccagctacttgggaagctgaagtgggaggatcacctgagctctggaggtggaggctgccatgagccatgatcgtgccactacactccagcctgggtgacagagtgagatcctgtctc

SEQ ID NO: 155796 - DNA, 1762 bp, Homo sapiens
  Payload ID: 10605
  Gene Symbol: MCOLN3
  Gene Name: mucolipin 3
  Uniprot ID: Q8TDD5
  ENST ID: ENST00000341115
  CDS Start-End: 54-1547
gcgccctcgccgcggacaccggagctgcggccgctccccgctgtcccccagagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaagagtctaactagttatgatgtctgtagcatacttcttgggacttctaccatgctcgtgtggcttggagtcatccgatacctcggtttctttgcaaagtacaacctcctcattttgacccttcaggcagcgctgcccaatgtcatcaggttctgctgctgtgcagctatgatttacttaggttactgcttctgtggatggatcgtgctggggccttaccatgacaagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgagg

SEQ ID NO: 155797 - DNA, 2953 bp, Homo sapiens
  Payload ID: 10605
  Gene Symbol: MCOLN3
  Gene Name: mucolipin 3
  ENST ID: ENST00000370587
  CDS Start-End: 378-1343
tggagtcgctcgctgactcgccctgcgccctcgccgcggacaccggagctgcggccgctccccgctgtcccccagcttactccaatcaagcctctgcccgccaggaacaggtaacctgtgtgtgtccgtttgctccttctaagagcatgcctgatagatacttcggtagcctctccggatggccccttcgtcgggtagcctctcctgatggggtccttcgcccaccctgcctcccgcgccggcgctccgggtgaatgtcaagggtggctggctgcgaatacctccttcagctgctggggttcccgacagtttgcagtttttaaaagtgcaccctcggaagggcttttcagactgggtaaacctgacttttccaagagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagctggtcttatttgggctaagtaaccagatggtggtagctttcaaggaagagaatactatagcattcaaacaccttttcctaaaaggatatatggaccgaatggatgacacatatgcagtgtacacacaaagtgacgtgtatgatcagttaatcttcgcagtaaaccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggtagggaacgttgctttctaggaatgctactgacattttgattgacagagacattcactgtgcctcccctcttttccctaaaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaaggtaatttttttcctaatcatgctattgttagtgtcagatttgcactaatggtaatgtatttttccagaatgtaagaattttcagaatgaattgtttcttccaaactgtatatcaagtagacttgaaattggtaatggtaattttcttaaatctagtcaggaggtctcttaggcagagtttttcaaagtgtgatccacaaaccattgcatcagaatcattgggtgcctggtaaagtgtaccatgttagacctactgaattcagactcttcggcggggcctgtgaattcttacacacaccaaaattcatacacaaccaaggtaactaaggtaagagttttttttttttttttaatcttacaagaaatgctcgaatctttaacaaaaatgagtggggctataggggaaagtgaggtcaaggcactatggtgtgcatgcttgcatttgtttcctccgtccattcaaagtgagaatgctcccattttcttactttaccattgatgtgctacaagcttatttattttaagactaacctagcctaaaaatcaactgtccccacaaaataaaaatcacattaaaaaaactaatagtgttcagactaatcttgctcaaacttatgtttccctagtcttgatgcaactgattgagtcacctggggagttggttataaacctgggcagagaccccaaatgcaatggctcagagaagataggagcttatttctgtcttatgcaatagtcagaatgggttttacagactggtgagtagctcaacatctcacagtcattcaggcacccatgttcctcccattttgtttctctgccaccccttaaggacttgccctgactgcatgattattgccgtgttgcctcaaacaggttgcagcttatgggaagcaaaaacacggtatggtagaagctctcccatagactgatggcttggctcaagagtggccgactttatttctgtacatatcccactggatagaatttagtcaatcctaactgcagagggagccagggaacacagcccaggcatgtgcctaggaaggggagaatgggtttaggttgacacttagcagctgccactatatgtggctatagtatgtatcattggaatagatgtttaactttagggacaaataaaaaaccaaaacaaaaaaaggagtaaggggagagatttgcagcaaatctttatttttaccaacctcaactatcattaatttcagtgaaccctaaatggtatccaacaaaatatctttctagaccattcaccgtctctgcctcatagatgatcatatcatgttttcttctcttctgaaacctctaatacccttgtcctatcctcattctaagctgatgaccttacttcctatttcacaaaaataatagaaaaaaaaaa

SEQ ID NO: 155798 - DNA, 2756 bp, Homo sapiens
  Payload ID: 10605
  Gene Symbol: MCOLN3
  Gene Name: mucolipin 3
  Uniprot ID: Q8TDD5
  ENST ID: ENST00000370589
  CDS Start-End: 54-1715
gcgccctcgccgcggacaccggagctgcggccgctccccgctgtcccccagagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagctggtcttatttgggctaagtaaccagatggtggtagctttcaaggaagagaatactatagcattcaaacaccttttcctaaaaggatatatggaccgaatggatgacacatatgcagtgtacacacaaagtgacgtgtatgatcagttaatcttcgcagtaaaccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaagagtctaactagttatgatgtctgtagcatacttcttgggacttctaccatgctcgtgtggcttggagtcatccgatacctcggtttctttgcaaagtacaacctcctcattttgacccttcaggcagcgctgcccaatgtcatcaggttctgctgctgtgcagctatgatttacttaggttactgcttctgtggatggatcgtgctggggccttaccatgacaagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgaggaaagctattggattattattatttcttgtttattttgccatggctttagaatgtattctgtatgcctctcttttgctctgatactgttgctcctgctattctgattgtgcagactgtgtaattagtggaaaacaatccttggtctgactgtgactttggacaactcagtaaccctggcttggaccactctcaggagtccatccttgagagagtgggtgtagttatcatttatacagtaatcattgcattttaaaatcttctcttgaaaggaagaataagagtgcaccagaataagagcgcaccagaataagagcgcaccagctaacaatgtgatacggccatatgtcacttaaggatggagatatgttctgagaaatgtgtcattaggcgattttgtcattaaacatcatagcatgtacttccacaaacctagatggtatagcctactacacacctaggctatttggtatagcctgttggtcctggggtacaaatctgtacaacatgttactgtattgaatacagtaggcaattgtaacacaatggtaagtatctaaacatagaaaagggacagtaaaaatatggttttataatcttctgggaccaccattgtatatgcggtacatcattgaccaaaacatcgttatccagcatatgactgtatttggttatgaaagccaactgttacttgattctgcttttagttcttaagaggatcaggcttttaaatactcatttacaagttttctatcctccttcagtgttaaagtagaaagtaaaaagagtatcttatacatgcatgaaattaaagcatataccaaatgca

SEQ ID NO: 155799 - DNA, 2777 bp, Homo sapiens
  Payload ID: 10605
  Gene Symbol: MCOLN3
  Gene Name: mucolipin 3
  ENST ID: ENST00000490600
  CDS Start-End: 142-567
actctgggcggagcggggctcgaggctgctggagtcgctcgctgactcgccctgcgccctcgccgcggacaccggagctgcggccgctccccgctgtcccccagcttactccaatcaagcctctgcccgccaggaacagagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagctggtcttatttgggctaagtaaccagatggtggtagctttcaaggaagagaatactatagcattcaaacaccttttcctaaaaggatatatggaccgaatggatgacacatatgcagtgtacacacaaagtgacgtgtatgatcagttaatcttcgcagtaaaccagggtaatgataagtgctatgaagaaaaataaactagcataaggcaataacagtagtctcggagtggtcagaaaatgcctttctgaagacttgaaatcttggggagaatatttcaagctgaaggcgtggcaacagaaggccctgaagctggaaagcgtttgtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaaggtaatttttttcctaatcatgctattgttagtgtcagatttgcactaatggtaatgtatttttccagaatgtaagaattttcagaatgaattgtttcttccaaactgtatatcaagtagacttgaaattggtaatggtaattttcttaaatctagtcaggaggtctcttaggcagagtttttcaaagtgtgatccacaaaccattgcatcagaatcattgggtgcctggtaaagtgtaccatgttagacctactgaattcagactcttcggcggggcctgtgaattcttacacacaccaaaattcatacacaaccaaggtaactaaggtaagagttttttttttttttttaatcttacaagaaatgctcgaatctttaacaaaaatgagtggggctataggggaaagtgaggtcaaggcactatggtgtgcatgcttgcatttgtttcctccgtccattcaaagtgagaatgctcccattttcttactttaccattgatgtgctacaagcttatttattttaagactaacctagcctaaaaatcaactgtccccacaaaataaaaatcacattaaaaaaactaatagtgttcagactaatcttgctcaaacttatgtttccctagtcttgatgcaactgattgagtcacctggggagttggttataaacctgggcagagaccccaaatgcaatggctcagagaagataggagcttatttctgtcttatgcaatagtcagaatgggttttacagactggtgagtagctcaacatctcacagtcattcaggcacccatgttcctcccattttgtttctctgccaccccttaaggacttgccctgactgcatgattattgccgtgttgcctcaaacaggttgcagcttatgggaagcaaaaacacggtatggtagaagctctcccatagactgatggcttggctcaagagtggccgactttatttctgtacatatcccactggatagaatttagtcaatcctaactgcagagggagccagggaacacagcccaggcatgtgcctaggaaggggagaatgggtttaggttgacacttagcagctgccactatatgtggctatagtatgtatcattggaatagatgtttaactttagggacaaataaaaaaccaaaacaaaaaaaggagtaaggggagagatttgcagcaaatctttatttttaccaacctcaactatcattaatttcagtgaaccctaaatggtatccaacaaaatatctttctagaccattcaccgtctctgcctcatagatgatcatatcatgttttcttctcttctgaaacctctaatacccttgtcctatcctcattctaagctgatgaccttacttcctatttcacaaaaa

SEQ ID NO: 155800 - DNA, 1572 bp, Homo sapiens
  Payload ID: 10606
  Gene Symbol: MADCAM1
  Gene Name: mucosal vascular addressin cell adhesion molecule 1
  Uniprot ID: Q13477
  ENST ID: ENST00000215637
  CDS Start-End: 47-1195
ctatttaagcggcttccccgcggcctcgggacagaggggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgat

SEQ ID NO: 155801 - DNA, 1309 bp, Homo sapiens
  Payload ID: 10606
  Gene Symbol: MADCAM1
  Gene Name: mucosal vascular addressin cell adhesion molecule 1
  Uniprot ID: Q13477
  ENST ID: ENST00000346144
  CDS Start-End: 47-934
ctatttaagcggcttccccgcggcctcgggacagaggggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatg

SEQ ID NO: 155802 - DNA, 603 bp, Homo sapiens
  Payload ID: 10606
  Gene Symbol: MADCAM1
  Gene Name: mucosal vascular addressin cell adhesion molecule 1
  Uniprot ID: Q13477
  ENST ID: ENST00000382683
  CDS Start-End: 1-603
atggatttcggactggccctcctgctggcggggcttctggggctcctcctcgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctga

SEQ ID NO: 155803 - DNA, 1723 bp, Homo sapiens
  Payload ID: 10606
  Gene Symbol: MADCAM1
  Gene Name: mucosal vascular addressin cell adhesion molecule 1
  ENST ID: ENST00000587541
  CDS Start-End: 855-1346
acccgcggaaaaggagggggagcggctggtcagctgcgccctgcgggtcgagaatgtcatcagcagggatggcggcgctttgagtgctgagcgcggccccgaccgggaccccctacccttgacccaccctcgcaggccgagccccgactcccgacccgccgtcgcagcccgcggccccgacctctgacccgccctcgcagcccgcggccccgacctctgacccgccctcccagccagaccctctacgcccgacccgccctcgcagcccatggcccatcggcccggcagtggacgcagagcctcggccccgttccctccccggaccccccggacccgctctccgtcctccctgcagagccgagggccttggcccagccccgcatcctccccgaccgtgctcgatccagcccgggtgtgctgcacccgaaacaggctcccgggggccgtcgggcctgtgggtgaccgtgcaggccaggatctcccccttcccagtcgtgacaaccacagatggccccagatgccacgttagggttagtgcctcctgggggcgggattgcggccgggggagaaccaccctcccaacccgttaggaactgcagggacggagagcgcgctcgggatgtccagcactcagcgcgggttgggtggcgaatggagagcgagtcgtcctcagaggccgccggcctgcaggcgagaaccctcccagccaggaggctgcggctctgcctgaaccccgacccagggcgaacacccacatttggcccctgcccggtgctgagagaggccagagcggcgtccccagaagcggagcgggagccccacgtccggcggccacgatagaaagaagaaaagaaatgggtggtatcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgat

SEQ ID NO: 155804 - DNA, 1461 bp, Homo sapiens
  Payload ID: 10606
  Gene Symbol: MADCAM1
  Gene Name: mucosal vascular addressin cell adhesion molecule 1
  ENST ID: ENST00000622462
  CDS Start-End: 47-1219
ctatttaagcggcttccccgcggcctcgggacagaggggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcccttcacgctctgtccaatcccgaagcccctgccccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaacc

SEQ ID NO: 155805 - DNA, 1509 bp, Homo sapiens
  Payload ID: 10606
  Gene Symbol: MADCAM1
  Gene Name: mucosal vascular addressin cell adhesion molecule 1
  ENST ID: ENST00000613880
  CDS Start-End: 47-1267
ctatttaagcggcttccccgcggcctcgggacagaggggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcccttcacgctctgtccaatcccgaagcccctgcggcagaaagcccccaagcaccttctctctccacgccagcctcctcccacccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaacc

SEQ ID NO: 155806 - DNA, 1203 bp, Homo sapiens
  Payload ID: 10606
  Gene Symbol: MADCAM1
  Gene Name: mucosal vascular addressin cell adhesion molecule 1
  ENST ID: ENST00000621286
  CDS Start-End: 1-1203
atggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtccgctgggtgccctggagacccacccgctcgccagccttgacaagcacttcggagtcccacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctga

SEQ ID NO: 155807 - DNA, 1485 bp, Homo sapiens
  Payload ID: 10606
  Gene Symbol: MADCAM1
  Gene Name: mucosal vascular addressin cell adhesion molecule 1
  ENST ID: ENST00000619333
  CDS Start-End: 47-1243
ctatttaagcggcttccccgcggcctcgggacagaggggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgctccatggctggctctctcctcctccccctcagaacacgggccctcacgggcctcacccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaacc

SEQ ID NO: 155808 - DNA, 1491 bp, Homo sapiens
  Payload ID: 10606
  Gene Symbol: MADCAM1
  Gene Name: mucosal vascular addressin cell adhesion molecule 1
  ENST ID: ENST00000617201
  CDS Start-End: 47-1249
ctatttaagcggcttccccgcggcctcgggacagaggggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtccgctgggtgccctggagacccacccgctcgccagccgacagcacttcgccagtcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaacc

SEQ ID NO: 155809 - DNA, 2091 bp, Homo sapiens
  Payload ID: 10607
  Gene Symbol: MCIDAS
  Gene Name: multiciliate differentiation and DNA synthesis associated cell cycle protein
  ENST ID: ENST00000513468
  CDS Start-End: 178-717
cccgccatctctcagcacctcctcggcagcccctcggctccttctcggtcacgcgcctgccccaacctctggctggcttcggagcctgcaggcactgaagggagtgcagggtgtggatcgctgccccagcccgggccgccgcctccgagcagtcggcacccggaggcaggaggcacaatgcaggcgtgcgggggcggcgcggccggccgtcgggccttcgacagcatctgccccaacagaatgctggcactgccgggccgggcgctgctctgcaagccggggaagccggagaggaagttcgctcctccgcggaagttcttccccggatgcacaggcgggagcccggtgtcggtgtacgaggatcccccggacgccgagcccacagcgctgccagccctcaccaccatagacctgcaggacctcgctgactgctcttcgctactcgggtccgacgcgccgcctggtggtgacctggccgcctcgcagaaccattcccaccaaacggaagcagacttcaatctgcaagatttcagagacacggtggatgatctcatttcaggcaaactcatcctctatgatgtcgcctaccctggccagcggagacttccccttctctccttgcgacatatcaccattcgggccctgcctctccccgccactggacccacgggccctgcagtcaccaccgctgcgccctccagacgtgcccccgcctgagcaatactggaaggaggtggcggaccagaaccagagagcgttgggagacgcgcttgttgagaataatcaactgcacgtgacattgacccagaaacaggaggagatcgcctcgctcaaggagcggaacgtgcagctgaaggaactcgccagccgaacccggcacctggcctcggtgctggataagctgatgatcacacagtcccgggattgtggggcggcggccgagcccttcctgctcaaggcgaaggccaaaaggagcctggaggagttggtcagcgctgcggggcaggattgcgcggaagtggacgccatcctgagggagatttccgagcgctgcgatgaagcccttcagagccgcgatcccaagcggccccgactgctgccagagcccgcgaatactgacaccaggcccgggaacctgcatggcgccttccgggggctgcgcacagactgcagccggagcgcgttgaacctgagccacagtgagctggaggagggcggctccttcagcacccgcatccgcagccacagcaccatccgcaccctcgccttcccccagggcaatgccttcaccatcagaacagccaacgggggttacaagttccgctgggtccccagttgagctgtgatgtggtcccccaaaacactgccctgtgtttccactgaagtgcctgggggcttcccagaactttgccttcaggttgaatgccaccctgaaacactttttcaggaacaaaagcatcttgataccgatgcattgtaaatttctgctacaaaacattgtatagcccctccccttgtcacagtgaaactctgtttatatatgtatatgtcacatatgtcacagccaattttaaaagtatttatttttagcagctttgaattatgtatttttagagcagggaaggatttagaaaccatagttacttttataattatgtaatgctctaatattataagaaggaaaagaaggctctaagagattaagtaatttcctgcaatgggaaacactggaacctttcaatcactttaactagtcacttaaggactctaggcccagaagcctggtttctgggtgaatgtttttatacatcactcaacttccctcgtcctaaaaggacacctaattttgttactattgaaaatttttattttggtggccagaatacgaaatcgggagaggtaacccaaacagttgtcttaggaaaaggcagattctcagaggcaatgggctatcaacaaaataggtgctaagcacatttgtttgtaatgatcattcatataatttagaagatttatggtaacagtttatattcattatccatacagttctatttgtgcaaatagaataaccacctataagcaaacagtgtt

SEQ ID NO: 155810 - DNA, 1736 bp, Homo sapiens
  Payload ID: 10607
  Gene Symbol: MCIDAS
  Gene Name: multiciliate differentiation and DNA synthesis associated cell cycle protein
  Uniprot ID: D6RGH6
  ENST ID: ENST00000513312
  CDS Start-End: 178-1335
cccgccatctctcagcacctcctcggcagcccctcggctccttctcggtcacgcgcctgccccaacctctggctggcttcggagcctgcaggcactgaagggagtgcagggtgtggatcgctgccccagcccgggccgccgcctccgagcagtcggcacccggaggcaggaggcacaatgcaggcgtgcgggggcggcgcggccggccgtcgggccttcgacagcatctgccccaacagaatgctggcactgccgggccgggcgctgctctgcaagccggggaagccggagaggaagttcgctcctccgcggaagttcttccccggatgcacaggcgggagcccggtgtcggtgtacgaggatcccccggacgccgagcccacagcgctgccagccctcaccaccatagacctgcaggacctcgctgactgctcttcgctactcgggtccgacgcgccgcctggtggtgacctggccgcctcgcagaaccattcccaccaaacggaagcagacttcaatctgcaagatttcagagacacggtggatgatctcatttcagactcatcctctatgatgtcgcctaccctggccagcggagacttccccttctctccttgcgacatatcaccattcgggccctgcctctccccgccactggacccacgggccctgcagtcaccaccgctgcgccctccagacgtgcccccgcctgagcaatactggaaggaggtggcggaccagaaccagagagcgttgggagacgcgcttgttgagaataatcaactgcacgtgacattgacccagaaacaggaggagatcgcctcgctcaaggagcggaacgtgcagctgaaggaactcgccagccgaacccggcacctggcctcggtgctggataagctgatgatcacacagtcccgggattgtggggcggcggccgagcccttcctgctcaaggcgaaggccaaaaggagcctggaggagttggtcagcgctgcggggcaggattgcgcggaagtggacgccatcctgagggagatttccgagcgctgcgatgaagcccttcagagccgcgatcccaagcggccccgactgctgccagagcccgcgaatactgacaccaggcccgggaacctgcatggcgccttccgggggctgcgcacagactgcagccggagcgcgttgaacctgagccacagtgagctggaggagggcggctccttcagcacccgcatccgcagccacagcaccatccgcaccctcgccttcccccagggcaatgccttcaccatcagaacagccaacgggggttacaagttccgctgggtccccagttgagctgtgatgtggtcccccaaaacactgccctgtgtttccactgaagtgcctgggggcttcccagaactttgccttcaggttgaatgccaccctgaaacactttttcaggaacaaaagcatcttgataccgatgcattgtaaatttctgctacaaaacattgtatagcccctccccttgtcacagtgaaactctgtttatatatgtatatgtcacatatgtcacagccaattttaaaagtatttatttttagcagctttgaattatgtatttttagagcagggaaggatttagaaaccatagttacttttataattatgtaatgctctaatattataagaaggaaaagaaggctctaagagattaagtaatttcctgcaatgggaaacactggaacctttca

SEQ ID NO: 155811 - DNA, 4967 bp, Homo sapiens
  Payload ID: 10608
  Gene Symbol: MMRN1
  Gene Name: multimerin 1
  Uniprot ID: Q13201
  ENST ID: ENST00000264790
  CDS Start-End: 72-3758
cagctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaatttaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctgaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggt

SEQ ID NO: 155812 - DNA, 5217 bp, Homo sapiens
  Payload ID: 10608
  Gene Symbol: MMRN1
  Gene Name: multimerin 1
  Uniprot ID: Q13201
  ENST ID: ENST00000394980
  CDS Start-End: 320-4006
agagaggccaagaggtttctgcttctattgatgttagcatttggttataaccacgggcaaagaatattaagctttgtcagagacccttcagcacttccatagagccatcccactagaggtcacagatcacaaaaaccctacagaaacaggaaaccgaacttcctgagtacgctacaaaacacagaaacctgtttcctctacacatctcaaactggcaaaactcagtcttagcagattcagtgtggaagcagctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaatttaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctgaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggtaa

SEQ ID NO: 155813 - DNA, 3234 bp, Homo sapiens
  Payload ID: 10608
  Gene Symbol: MMRN1
  Gene Name: multimerin 1
  ENST ID: ENST00000508372
  CDS Start-End: 285-3197
atccgttagcctgcctttgtggtctgcacgctgggaaagcctgacacctactggaatagaaacagtttacaacgcccggaatatgctcaagtcacagttttgcaaggaagggggaaacaaaaaataaaattaggaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaatttaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctgaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaa

SEQ ID NO: 155814 - DNA, 4375 bp, Homo sapiens
  Payload ID: 10609
  Gene Symbol: MMRN2
  Gene Name: multimerin 2
  Uniprot ID: Q9H8L6
  ENST ID: ENST00000372027
  CDS Start-End: 323-3172
cttttcatggctcccagggagcaggttcccataaggatgcatttggtggggccaccccatgtctaccacattcccagagtccctgagccaagtcctcagggacaggaactggcttgtgtggttggcggcccctgtggggccagccagggtagttggggggcaggacaagacccaccgggtaggccggcccaggccacttcctctctttgttgtcctcgtattttcttttcctcctgagatttaacttgaagacaacgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccggcaaggaccccgtaggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttcacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaa

SEQ ID NO: 155815 - DNA, 829 bp, Homo sapiens
  Payload ID: 10609
  Gene Symbol: MMRN2
  Gene Name: multimerin 2
  ENST ID: ENST00000474994
  CDS Start-End: 460-829
ccagatcccatcctccggaaagggttagtcaggcaagtgtgctgagaggcccctgggaacctcgtctcgattaacccatcagaaagcagcccatcctttgcacccagctctcagatggaaaagtgaagcccagaaggaagggacctgacacggaggcttccttggtagcatttcagtctcaagggaagaactgtgggcctcccctggagcactggtgaagtaaggggttggtttggatattgtctcctgactgggatatgggcaggactgacagggagctggagtcctaacgaagcctgggctaggtgcaggaagaaccaacccagtggtctcctgacatctcccacgcccccaccgcagctgggtcacctccagaatacggaggagagagctggaggtggaggaactaaggaccttctttgccaggtggggacttaaagtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctcc

SEQ ID NO: 155816 - DNA, 599 bp, Homo sapiens
  Payload ID: 10609
  Gene Symbol: MMRN2
  Gene Name: multimerin 2
  ENST ID: ENST00000608090
  CDS Start-End: 31-360
agtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccggcaaggaccccgtaggacggataatggattccagaatcccagcactgctccggcaggaggcgaggaccggtggctctgcactggcaccccctgttgacctgggtgtggctcagcagccttctcctctggcttgttttccagtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccag

SEQ ID NO: 155817 - DNA, 890 bp, Homo sapiens
  Payload ID: 10609
  Gene Symbol: MMRN2
  Gene Name: multimerin 2
  ENST ID: ENST00000609457
  CDS Start-End: 279-890
atttcagtctcaagggaagaactgtgggcctcccctggagcactggtgaagtaaggggttggtttggatattgtctcctgactgggatatgggcaggactgacagggagctggagtcctaacgaagcctgggctaggtgcaggaagaaccaacccagtggtctcctgacatctcccacgcccccaccgcagctgggtcacctccagaatacggaggagagagctggaggtggaggaactaaggaccttctttgccaggtggggacttaaaggtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtg

SEQ ID NO: 155818 - DNA, 1020 bp, Homo sapiens
  Payload ID: 10609
  Gene Symbol: MMRN2
  Gene Name: multimerin 2
  ENST ID: ENST00000610081
  CDS Start-End: 136-1020
ggcagctccaaaccaggccagaggagccccacatccactctgggttggccactgggagatgagggcacccagcaggactccccaagggagggcacaaagatgaagccagcctgagacggaggggcagagggaaaaatgggcacttcagcaagttgggccgggggcatgggcatcaagggccagccagaagctgccaagagctggaggaagccaaagcaaagtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttacc

SEQ ID NO: 155819 - DNA, 2337 bp, Homo sapiens
  Payload ID: 10610
  Gene Symbol: MCTP1
  Gene Name: multiple C2 domains, transmembrane 1
  Uniprot ID: Q6DN14
  ENST ID: ENST00000312216
  CDS Start-End: 1-2337
atgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctag

SEQ ID NO: 155820 - DNA, 3159 bp, Homo sapiens
  Payload ID: 10610
  Gene Symbol: MCTP1
  Gene Name: multiple C2 domains, transmembrane 1
  Uniprot ID: Q6DN14
  ENST ID: ENST00000429576
  CDS Start-End: 164-2242
attccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaagtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcagagaaaaaaaaaa

SEQ ID NO: 155821 - DNA, 1702 bp, Homo sapiens
  Payload ID: 10610
  Gene Symbol: MCTP1
  Gene Name: multiple C2 domains, transmembrane 1
  ENST ID: ENST00000514780
  CDS Start-End: 1-510
aaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggtaattcttagcttgtgatctttcagcttttcttgttgagcagaactatcatctgctttcccagatctctctcatctcttcaaagtatgctaccagatttcatactattcaattgttacttttccccataaatttaagccaaccatgtgatgttttttaaatagaaatcacaccgatcaatagcttcaaatcatcctttcactattctctggtcacttctcaacatcattctcagcatctggtctcaactatatatgcaacagggtctagaaaattgctctgagccaggaataaaatgatgaggctaggggagggacaactccagacagaagaaagattcgcacaatttattttattttggggggtcacagaaaattgagtatgaggctttctaaactcagaaattcctgtatcattacatctttatagtatacaataagaacaatttttccccattgtctcttctcactttaagaaataaagtgagaggagtttatggttcctgtaacttactaagccctggctcttcttcaacttgtaagatatgcaaaatataaactaagtgtttaatttgttcagtgatgctgccactgttggacacagatcgatatcaagatgaaacaatttttatatgaatataccttgaaataaatcaaaacgattttacttgtaaaaatcttgtctgctcaaatttctacttagagtcagtattcctttttaataatgactaatttttttagaccctggaacatgacagtctttttccttccattctgattgaatcatgcttttacctaagcttttctttaattttgtcatttttattactgtgaattaatatatatcaaaatgtttttatatttatggtaatgacttaatctgtttgaacaagtgtctcttactgtacattttctccctaattcctatggcattaatggcattaatgaccaaagaataatttggcttacaaaaaagtcagggctcccattaaaaatcacctttattattttaataaaatgaaaaaggcttattaaggaaggttgctgaatatttctaacttaatgttcactgtgattttcactaatcaaaataaagtttcaagatgttttgaagaaatatttgcactgttcatatttgtattactttttcctttacagttatactttacagttattgttatattaaaagtgtatatatttttaaattcata

SEQ ID NO: 155822 - DNA, 570 bp, Homo sapiens
  Payload ID: 10610
  Gene Symbol: MCTP1
  Gene Name: multiple C2 domains, transmembrane 1
  ENST ID: ENST00000510732
  CDS Start-End: 165-570
cattccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaccctgtatggtaagattggaaaggacagactaaatgcagtaaacaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggct

SEQ ID NO: 155823 - DNA, 483 bp, Homo sapiens
  Payload ID: 10610
  Gene Symbol: MCTP1
  Gene Name: multiple C2 domains, transmembrane 1
  ENST ID: ENST00000505465
  CDS Start-End: 240-483
cctgttgtggcttttgccatgaggaagaggttgactactaacactgcatgtttgatttagcaggtgaagtttttagtatttaattcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacaca

SEQ ID NO: 155824 - DNA, 2214 bp, Homo sapiens
  Payload ID: 10610
  Gene Symbol: MCTP1
  Gene Name: multiple C2 domains, transmembrane 1
  ENST ID: ENST00000508509
  CDS Start-End: 164-2214
attccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactact

SEQ ID NO: 155825 - DNA, 5396 bp, Homo sapiens
  Payload ID: 10610
  Gene Symbol: MCTP1
  Gene Name: multiple C2 domains, transmembrane 1
  Uniprot ID: Q6DN14
  ENST ID: ENST00000515393
  CDS Start-End: 1-3000
atggagccccgggctgccgcggcgggcgagccagagccgccggcggcgtcctcctccttccaggcccggctctggaagaacctgcagctgggggtgggcaggagcaagggcggcgggggcgggcgcgctgggggtccagagcgccgcactgcggacaccccgtcgccctccccgccacccccggtgggcacagggaatgcaccggccagggggagtggtgcaggcagcaggtggagcggcttcaagaagcggaagcaagtgctggaccgagtcttctcctcctcgcagcccaacctgtgctgctcgtcgccggagcccctggagcccggcggcgccggcagagccgagcaggggtccacgctacgccgccggatccgcgagcatttgctccccgccgtaaaggggcccgcggcggcctcgggagcagcgggagggacgcctcctggcggacgctcccccgactcagctccttcctcttcctccgcctcatcctccctgtcctcctcgccccagcctcccccgaggggggaccgcgcccgagatgagggtgcacggcgtcagggccccggggcgcacttgtgccaccagaagagctcctctctgccgggcaccgcctgcctggagcagctgctggagccgccgcctcctcccgcagagccggcgcggagtcccgcggagtctcgggccccggagacgggcgaggagcacggcagcagccagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcagagaaaaaaaaaacctgctttctcattagattactgaaatgctttaattcatactatgattttgttattagtgtgaattttaatgtagagaattcagtgtgctaagtgatatgccagtgtttcactacattcatttattaaaaaaaatcattcttgattatgcatgaaaacctgttttgtaaaataaaataaactgcttgggggtggtggttgcctttatcaatgtttcactattatcatagaatctatacttaaaaattgcattcccaagactcttaaagtagtttttatatctcactccctggtatactaagggagcataactctggagaaaaaataatttggttggttgagaatgtcttacttccctgacttggtaggggactacactcagttgaaattgcagcagacaatgctttgcactactttattaataataaacttggatggggtaaaagtgggggttatactggaaaaactatagaaaagctaaaagaaatgtatatttcactctaaaggaagattctttaacaataaatgtaatctcattgaagctgatttttaaagtatttttattttagagataagttgttaaatactatttcttataatagaactattttgatctgtttatatactatgcttgaatgtcaattaaattccctttctacagaaaggctttgacctcaacatgctttatttaatgtatcatgtttaaaatgacatgcttctgtctgcataccatcactgtttgttgctaaaaacataatgttccatgaacatgatgttactacagaaagtttattgatgagataactgtttgaaataactttcaattataccttatgtgagacttttatgttctgtgctgacaatgtgtactcaaatgtctataagcctgatattctacaacctcagatgtatctagtggatagtaaccattaacagatgactaatttgtttcactgtatcaaatttcagatgtttagttcaatggtaatgctgactacacattcactgtattaaatacaaaagaaaataatctttcccacgtataatcagcactccttttttttttttttttggtggttcagagattgatgagggattgtgtgcatattcttaaaaactatatgtcacttggagaaaaacagatttggtttaaacaaataagacctttttcctgaaactctgactcttatatgaaaatacctctggaggggtgagcaaccaatgacattaacagaggaataagaactagcttgaggcacaaaagtgatattcagggaaatcttcattgcttttagaaactactacattcacaggctgaaaacagaatatgtatagttaaaattttaactatttatttctttccccttctcacatagctgcaattctgtcttgagagctgcctgacttgccttcattttgagatctgtgatgtaaatatttcttaagagactgaatgtcactcaaacatctacttggactg

SEQ ID NO: 155826 - DNA, 575 bp, Homo sapiens
  Payload ID: 10610
  Gene Symbol: MCTP1
  Gene Name: multiple C2 domains, transmembrane 1
  ENST ID: ENST00000507214
  CDS Start-End: 1-575
cagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgtttcagacccaaagtttacgcctatcagacctacacagaaaatcgcatctttggagaggaatagtcagcatcaccttgattgaagggagagacctcaaggccatggattccaacgggtt

SEQ ID NO: 155827 - DNA, 874 bp, Homo sapiens
  Payload ID: 10610
  Gene Symbol: MCTP1
  Gene Name: multiple C2 domains, transmembrane 1
  ENST ID: ENST00000503301
  CDS Start-End: 1-874
cttgtgccaccagaagagctcctctctgccgggcaccgcctgcctggagcagctgctggagccgccgcctcctcccgcagagccggcgcggagtcccgcggagtctcgggccccggagacgggcgaggagcacggcagcagccagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaagtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaaga

SEQ ID NO: 155828 - DNA, 2350 bp, Homo sapiens
  Payload ID: 10610
  Gene Symbol: MCTP1
  Gene Name: multiple C2 domains, transmembrane 1
  ENST ID: ENST00000506568
  CDS Start-End: 1-1245
actctgaaagatcctcattatcctgaccatgatcttggaatcattttgctctcagtcatccttacccctaaagaaggagagtccagggatgtggaactttcagaaaatgaagtggttggatcttatttctctgtgaagtctctcttttggaggtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtatgatcatactgtattacttacattgttattcattaaattcagtaatcatagctgcatgtttctgtggctatagtaacagttatgttgatgtggccattttaaaactcctattttaagacttgactggacagatttgccgtgggcaggaacctgatggattgtacaaggtctgagtctaagaatacattttcccccctcagatttccggaacgcaagacatctcagccaatgtatcattttctctgtgacagttaaaaagtaaaattttacatattgcataattccaaaccccaataggacagccaagaaaagtcctccatgtgaaaaataataatagtaataatctcgaccattctcaatttgattttatctgtcctatagttaatttttttcaagatatgaaaatcattggtagtagaatgctaccaatgctacttggtaatgctttaacatgtgattcaactggaagtggatgtgacctatttaagagatgttttattatttctgagatttctagcttttaaaagtcacaagtgagaattcgatagatccaaagagtcctttaatatgttcatcttgtggccttttactttgattatttaaaaacttctgatgagaccaactggcagagctagaaaatccaaaagaatactttgctctgagctttagctgggattttcttctctcacattattttggctttttcaggatttcagtttgaagtttaagtagagtcattcttttgaaatcctttattttattttcatgtttgttcaaatatgagtaccttatgcttccttatagttgccagtttagcagaatacgactttattatgggggcttacaagaagagccttaattatagtaacaaatcaacattttagtattaccattcaaatgagtgtatgcacatctgtttagtactttgagctctgtcttcctctcaggccttgtatgggactttcattaatgtctgagcacatggaacaaagagtgtctacgtccctttgtgttgtaagttaccagaaagttaggcagcctgcttcccatagacgtgttgttgtctccctaaagaaagcaattgtcattatcgttaagttttagaaaa

SEQ ID NO: 155829 - DNA, 2629 bp, Homo sapiens
  Payload ID: 10610
  Gene Symbol: MCTP1
  Gene Name: multiple C2 domains, transmembrane 1
  Uniprot ID: Q6DN14
  ENST ID: ENST00000505078
  CDS Start-End: 177-1724
acacactctgctacattgaaactgctccctgaatcttttcctccggtaaattgtgcttcctgggaaactaagggtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcag

SEQ ID NO: 155830 - DNA, 2158 bp, Homo sapiens
  Payload ID: 10610
  Gene Symbol: MCTP1
  Gene Name: multiple C2 domains, transmembrane 1
  Uniprot ID: Q6DN14
  ENST ID: ENST00000505208
  CDS Start-End: 146-1948
gcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggccttgtatgggactttcattaatgtctgagcacatggaacaaagagtgtctacgtccctttgtgttgtaagttaccagaaagttaggcagcctgcttcccatagacgtgttgttgtctccctaaagaaagcaattgtcattatcgttaagttttagaaaaaaaatctctctctctctgtctctctcagtattctttttgtagctctttcttataataaatatatggtggtactattaag

SEQ ID NO: 155831 - DNA, 1751 bp, Homo sapiens
  Payload ID: 10610
  Gene Symbol: MCTP1
  Gene Name: multiple C2 domains, transmembrane 1
  ENST ID: ENST00000512425
  CDS Start-End: 285-1751
ctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactg

SEQ ID NO: 155832 - DNA, 7555 bp, Homo sapiens
  Payload ID: 10611
  Gene Symbol: MCTP2
  Gene Name: multiple C2 domains, transmembrane 2
  Uniprot ID: Q6DN12
  ENST ID: ENST00000357742
  CDS Start-End: 1-2637
atggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacagtttgactttcactacttctctgacaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggtatttttgatcactgtctggaattttgaactatatatgatccccttggcattgttgctgatctttgtctacaatttcatcagacctgtgaaaggcaaggtcagcagcatccaggacagccaggagagcacagacatagatgacgaggaggatgaagatgacaaggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaagatctcatttaatagtgagttcactatttttttttttttgtctctgggttgtaatttaataatcttcaaacaaaatgtttacgaaaaatgccaaagattctaaatcttatcatcccgtgtctgtttttcttcatgttgtatctcactgggttgctttctggctgagccagaattctgcatgatttgatttacttcaagttaatgaagctggctggaaaagagccttgcagaaattataaaagctccagtaaatctcgtagttgtacatacaatagatacccaagaacctcttttgttaaaccagttactcaatcttctgtgtaaacaatgcctcattgtcttgcttctaactatcatctagtttatcatagtctgtcattttgtaacgacctaagtcagacatttttaaacagacatgtgagatctgatcagtcatttgaatgaaaactttcagcagcaaaataaccccttatttatttaaaagtggaaccaatactttattgttgttcttttgctatagaatttcaaaatgaaattatttgcccgacaagaaggcatcattagttagacttgtttcctctgtagcccgattgaaattctcagtgttaagtttaggacccaaacaccagctgggacgtaagagcaggaccgaatcaaccttgaataaactgtatatagaaaacaattgttagttgattaagtagacattggatgtttgttagaaaggaatgttagttgtaagtgacatgttaagatttatacaattgtcaaaaacttttaggaaagattccagaatgcttttgataaaatttatcgattgtggattcacagtgtgataattaagtagggatgttgaagtcttgccaagttttcctggttcccttctcaaactttatcttcccatttctagccctgtctctctatcttacaggcatctacacctcagcaagtcagaaactaaacatcatctgtctctccctgtcttcagaaccccaaccctcataatctccttccagcttccttatttcccttaccaggactggcattttctgggcttggaatttctcggtcatcctctttttttttgttcctcgtgctgttgtcctcgtctcccaacccctaaagcctagtaggtccagtgtcaatgcattaaccacttctgttctgatttccaccacccaagtggaggccttcataacctctcagacgtcacggccatgatgccagttacattatgcctagttaatcttcattcagactggaaggacctgcccccagttgtttctttctgaatagattctactctccttcaacacttccaaagtctcctgccccaaagaggcttagttagtcctgtggctggatgtgactccaacttccttttttgtaccatcacatctttcatatctttctggcatctgccatacatcataagaggctttgaccactgtcctccactgaatagcccattacagctagcacctaatagttactcaggaaataaatacatgtttaacaggccaggtcgtagagattatttttctttctctgccttttcatgtgctgctttcagaacagagggctggattggatagattagtatgatctatcctggagattcatttcttgcattaagagcttattttgtgtgatattatttataatccctgactatgtcaattataaacttttaaattatgtcttatatttgaagttcttacctacatatcagaggaaaatataatgtttatttctaggtggtaaaacaatcttctggattcttttttctttacttgtaaattatcatttaacaagtctatattgaatgccgataattttctggaacaaaacagactacattcccttggtaaagccagacattaaacagatactttcaagcaacagcatgccatgctcagatttaagtttgaaaaatattctagctgcaatggatagcctagcaattttcaaagtttagagaagttattaatattagccctttgtagtactcctgataaatgaataacaccctggactttcaaatagtggcactgggaaaaaagtaagtagaattgagagatggtgaagagataaagtgagcaggacttaacaattgctggactatgggatgagggagcgtagagtcaaggatggctctcagtccctaggtctccaggtctaggaagatggtgttacctttcactaagggagagaactgtaagaactgctgtgagaggaccacaggagtccagttttagcgctgaatctcaggtgactgaaaagcatccaaataggaatgtcagcaaggtaatggaatatatagttctcagagaagtaacacactgtacttgagatgtacacaagttaaaggcaaacattgtatatgaaaagtgatcaaaactacatgcttcaagaaattaaaccttgaagaactcaacagttaatgtcatatatagaaaggcaagtcagttaagagtgtaaatagaaacgggtaaatacagaggagaaaaacagtaagcatggactgtcctagaattcagtggcagagcatactgcaagaaagctgatgtggtcaataatatcaaatgccgctgagatcacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttcatgggcttgagatggagttagccatattcattattgaaaactatgttctgcacttatacattgttggttggagtgtaaattagttcaaccgctgtggaagacagggtgggtgtttcctcaaaaacctaaagacagaaataccatttgacccagcaatcccataactgggtatgtacccaaaggaatataaattgttctactataaaaacacatgcacacacatgttcactgcaacactatttacaatagcaaagacactggatcagtctaaatgcccatcattgatagaatggataaagaaaatgtggtagaggtacaccatggaatactatgcagccataaaaaagaatgagatcatgtccttttgcaggaacttggatacagctggaggccattatccttagcaaactaatgcagcaacagaaaaccaaataccacatgttctcatttataggtaggagttaaatgatgagaacacatggacatgtagaagggaacaaaatacactgggggctattggagggtgaagggtgaaaggaggaagaggatcaggaaaaataatgagtaccaggcttaatacatgggcgatgaaataatctgtatgacaagcctctctgacacagtttacctatgtaacaaacctgcacagttacccctgaactttaaaaaaaactatgttctatcaaaacctgcctctcatttatgtattaggaatcttgtgacaacggaacagttgaaaaattaaaataaaaattgcctgaaaatgca

SEQ ID NO: 155833 - DNA, 4493 bp, Homo sapiens
  Payload ID: 10611
  Gene Symbol: MCTP2
  Gene Name: multiple C2 domains, transmembrane 2
  Uniprot ID: Q6DN12
  ENST ID: ENST00000456504
  CDS Start-End: 350-949
gcctgggggtgggcgtcttctctcaaccgaagctgggagttggggagctggagggtccaggatgagaattcagtggcgctactaccccggagctgcttgtggttcagagatcagaaaggtgtcctgaggactggaggcagaaatccaggcgtggcgtactggaaggcgcactaggggagggcagcctggcccagaatttctttgcattttaaaggccacacattcagtctccccggggcgctacggaggtagtcaccgccacatccaggactccttccacagaggagtcattgcagttttcagtagaggtgtacttctgagaagtggcttcttgggtcttcatgcagccatggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgacagtcaaaagtttgaaatgactcaaaaatttaattgggctcatgtaatacatattcaaaaacagacttgaattctacaatatggccagcaggagttgatgcatttctggaggaggaagtgactgagttgcgggaaggtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacagtttgactttcactacttctctgacaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggtatttttgatcactgtctggaattttgaactatatatgatccccttggcattgttgctgatctttgtctacaatttcatcagacctgtgaaaggcaaggtcagcagcatccaggacagccaggagagcacagacatagatgacgaggaggatgaagatgacaaggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaagatctcatttaatagtgagttcactatttttttttttttgtctctgggttgtaatttaataatcttcaaacaaaatgtttacgaaaaatgccaaagattctaaatctt

SEQ ID NO: 155834 - DNA, 2472 bp, Homo sapiens
  Payload ID: 10611
  Gene Symbol: MCTP2
  Gene Name: multiple C2 domains, transmembrane 2
  Uniprot ID: Q6DN12
  ENST ID: ENST00000451018
  CDS Start-End: 1-2472
atggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacagtttgactttcactacttctctgacaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctag

SEQ ID NO: 155835 - DNA, 1422 bp, Homo sapiens
  Payload ID: 10611
  Gene Symbol: MCTP2
  Gene Name: multiple C2 domains, transmembrane 2
  ENST ID: ENST00000543482
  CDS Start-End: 193-1383
gatgcccccgcccccgccgcgtcagggttgctccctgcgcttccgagtggcgactgcagcgggtccggtgcaggtgaggggcgcgcgcctgcccagctttgcagcccccgaacgcggcctcgcacaggagtcattgcagttttcagtagaggtgtacttctgagaagtggcttcttgggtcttcatgcagccatggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaaggatgggcattttggacattgaagtgtggggaaaggacaacaaaaagcatgaggaacgtct

SEQ ID NO: 155836 - DNA, 1957 bp, Homo sapiens
  Payload ID: 10611
  Gene Symbol: MCTP2
  Gene Name: multiple C2 domains, transmembrane 2
  Uniprot ID: Q6DN12
  ENST ID: ENST00000557742
  CDS Start-End: 330-1250
ctgtgacagcaggtttgcaaaaccaatgaaaaaaacagttttccccaggcagggaggaattttttttataattaaatactgaaagttggaattcctatgatcatcaaagtcactctcaggaattagaagcaagtttacatgtcatctttattttttgctttagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcgcaccgcaaagaggaaccacccctgtctatgaaatgtacccttttctctggtgacattggcccatccttatgagcataataaaatcgcagaatcaaagcgctgcaagagatcttaaaaccacctaagtctaccactgagagcccaagaatcttggaaggacttcacagctggcctcatgccttcactttatatctcagggcattttctctcatttgtaaagggacttgtccttgatcaaattggtaatgtcagccatgggaggagaaatcaagtctcccgactgcaaatctttgtatatttggtatcatgccattcatttctgtcctgtgcaaagatcactataaaaactaatacgaggtatgagtggtctaagagtgtgaatatcagtcatgatcattggtgaatctgatttctgaatgttatgtggttctgcttctgttttctactgccaatatatgctgaatgttctctcttagccaacaggcatagcctcatataaaaaatgggggaaaaaaaacatttattagcccaagaagccaatgggttcaaggtcactcccaacatttttatgccatcaagtatatcagctccaaaagaggcttttcctttgccattggggggtattttgtttgctgtcgtttattttagttctccactgcttcggtgtagaggacctatgctgcctgtaggcttgacctttcctatactttttctgctgtctgaagttgctaaaacatttggccttaataaaaacactaataaaggttttattaatctgt

SEQ ID NO: 155837 - DNA, 4182 bp, Homo sapiens
  Payload ID: 10612
  Gene Symbol: MCFD2
  Gene Name: multiple coagulation factor deficiency 2
  Uniprot ID: Q8NI22
  ENST ID: ENST00000319466
  CDS Start-End: 153-593
aatgggcgggcggcagggagcgcgcgtgcgcagggcaggtcggggggggggggggggcggggcgaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 155838 - DNA, 648 bp, Homo sapiens
  Payload ID: 10612
  Gene Symbol: MCFD2
  Gene Name: multiple coagulation factor deficiency 2
  Uniprot ID: Q8NI22
  ENST ID: ENST00000409218
  CDS Start-End: 139-579
ggatccgccatcctacgtcgcccgtggaactacgttcctgagggcttccggcgttgcctagcaactgccgggcccctagggcgtccagcggcccaactggagtggagccgagtgtcgcccttgggaaagcagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaa

SEQ ID NO: 155839 - DNA, 821 bp, Homo sapiens
  Payload ID: 10612
  Gene Symbol: MCFD2
  Gene Name: multiple coagulation factor deficiency 2
  Uniprot ID: Q8NI22
  ENST ID: ENST00000409973
  CDS Start-End: 189-629
ggggcgaagccgaggaagagcgttttggggacgggggctggtgaggctcacgttggagggcttcgcgtctgcttcggagaccgtaaggagatgggggtctgactgtgttgtctaggctgatctcaaactcctggcctcaagtgatcctcctgcctcagcctcccaaagtgctgggattacagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagt

SEQ ID NO: 155840 - DNA, 1113 bp, Homo sapiens
  Payload ID: 10612
  Gene Symbol: MCFD2
  Gene Name: multiple coagulation factor deficiency 2
  Uniprot ID: Q8NI22
  ENST ID: ENST00000409207
  CDS Start-End: 168-608
tactcaccggtgtccggaaaggtgaacgctgcgctcgggctgcctcgcctgttacctccgccgccgggcatgctcagcgtctgcagctgccggaccagctccggcatgcggtcccagtggccctcggcgcggcagcgctccagctcgctctccaccttcagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctc

SEQ ID NO: 155841 - DNA, 4210 bp, Homo sapiens
  Payload ID: 10612
  Gene Symbol: MCFD2
  Gene Name: multiple coagulation factor deficiency 2
  Uniprot ID: Q8NI22
  ENST ID: ENST00000409105
  CDS Start-End: 181-621
acgggggctggtgaggctcacgttggagggcttcgcgtctgcttcggagaccgtaaggctgtcatcagctgtggacgggagccttctgaagggaagcacttgggagcctgcaggacgaatacctacaccagacttggaattgaaaagacctcactggagaaagagacatttgatatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 155842 - DNA, 3975 bp, Homo sapiens
  Payload ID: 10612
  Gene Symbol: MCFD2
  Gene Name: multiple coagulation factor deficiency 2
  Uniprot ID: Q8NI22
  ENST ID: ENST00000409913
  CDS Start-End: 102-386
gggggcggggcgaagccgaggaagagcgttttggggacgggggctggtgaggctcacgttggagggcttcgcgtctgcttcggagaccgtaagggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 155843 - DNA, 671 bp, Homo sapiens
  Payload ID: 10612
  Gene Symbol: MCFD2
  Gene Name: multiple coagulation factor deficiency 2
  Uniprot ID: Q8NI22
  ENST ID: ENST00000409147
  CDS Start-End: 292-576
gctcttaagactagcacggtgggctggcaggcgcccgctgtcggccgaggactgtctgggcgcgcttcctggaggaggcggtgcgtttcgcgcgctcgctgccggcgagccagcctcttcccttactcaccggtgtccggaaaggtgaacgctgcgctcgggctgcctcgcctgttacctccgccgccgggcatgctcagcgtctgcagctgccggaccagctccggcatgcggtcccagtggccctcggcgcggcagcgctccagctcgctctccaccttcaggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactact

SEQ ID NO: 155844 - DNA, 3955 bp, Homo sapiens
  Payload ID: 10612
  Gene Symbol: MCFD2
  Gene Name: multiple coagulation factor deficiency 2
  Uniprot ID: Q8NI22
  ENST ID: ENST00000409800
  CDS Start-End: 82-366
tagcaactgccgggcccctagggcgtccagcggcccaactggagtggagccgagtgtcgcccttgggaaagcaggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaa

SEQ ID NO: 155845 - DNA, 376 bp, Homo sapiens
  Payload ID: 10612
  Gene Symbol: MCFD2
  Gene Name: multiple coagulation factor deficiency 2
  ENST ID: ENST00000434262
  CDS Start-End: 1-273
tcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggcaaatttgtgcacagagctgaccctcaggaggactggcacttttccaattaaagaagaatgagccataatgaaacaaataagcaaaagcctattttgaagggccttcttttaactggcaaatgtaatttctaaactggattatgataaattgactcaataataca

SEQ ID NO: 155846 - DNA, 565 bp, Homo sapiens
  Payload ID: 10612
  Gene Symbol: MCFD2
  Gene Name: multiple coagulation factor deficiency 2
  ENST ID: ENST00000417180
  CDS Start-End: 382-565
agtaaggtaaatgagagccagaggagagagggtcctgactctcagagagggaggaaaagagaaaaatggaaaaggagaacaacctgtgatcgtatgttcaggtcaaatgagtgtgagaggctacagactgaggtcggatgagagagcaattggtcttggctggaagaatcctgaggtgacatttgaacctgtcctggaaggaagttggagatggacagatggaaccagtaggagcggaggctgtggtacaggaagaggctggcagagcaggaggggagcactgtgacagccaaggcactgggaggcgcactgctcctgatggtccagcactgccctcccaggactgaggctgcgccttgtgagggctgtctcaagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaaca

SEQ ID NO: 155847 - DNA, 4169 bp, Homo sapiens
  Payload ID: 10612
  Gene Symbol: MCFD2
  Gene Name: multiple coagulation factor deficiency 2
  Uniprot ID: Q8NI22
  ENST ID: ENST00000444761
  CDS Start-End: 193-576
gctcttaagactagcacggtgggctggcaggcgcccgctgtcggccgaggactgtctgggcgcgcttcctggaggaggcggtgcgtttcgcgcgctcgctgccggcgagccagcctcttcccttactcaccggtgtccggaaaggtgaacgctgcgctcgggctgcctcgcctgttacctccgccgccgggcatgctcagcgtctgcagctgccggaccagctccggcatgcggtcccagtggccctcggcgcggcagcgctccagctcgctctccaccttcaggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaacctc

SEQ ID NO: 155848 - DNA, 588 bp, Homo sapiens
  Payload ID: 10612
  Gene Symbol: MCFD2
  Gene Name: multiple coagulation factor deficiency 2
  Uniprot ID: Q8NI22
  ENST ID: ENST00000412438
  CDS Start-End: 151-588
acttccctgattcagcgatgagccaggtcagctcagcagagatcagtaagagatgggggtctgactgtgttgtctaggctgatctcaaactcctggcctcaagtgatcctcctgcctcagcctcccaaagtgctgggattacagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcag

SEQ ID NO: 155849 - DNA, 7594 bp, Homo sapiens
  Payload ID: 10613
  Gene Symbol: MEGF10
  Gene Name: multiple EGF-like-domains 10
  Uniprot ID: Q96KG7
  ENST ID: ENST00000274473
  CDS Start-End: 268-3690
tgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggtggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttcccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataaaaaa

SEQ ID NO: 155850 - DNA, 2238 bp, Homo sapiens
  Payload ID: 10613
  Gene Symbol: MEGF10
  Gene Name: multiple EGF-like-domains 10
  Uniprot ID: Q96KG7
  ENST ID: ENST00000418761
  CDS Start-End: 280-1983
aaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagcttctttggtttctaaaggagtaaactgagatgaactgtca

SEQ ID NO: 155851 - DNA, 2365 bp, Homo sapiens
  Payload ID: 10613
  Gene Symbol: MEGF10
  Gene Name: multiple EGF-like-domains 10
  Uniprot ID: Q96KG7
  ENST ID: ENST00000508365
  CDS Start-End: 230-1933
aaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctgggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagcttctttggtttctaaaggagtaaactgagatgaactgtcatgtgcttgatttctagtgtctgagagctaccttgggaaacaggctaaggctggtgcaatggactttattttctaccaataggagctacccacagacacgaggcctccccaaccctgtagttccatcttgacttgcaaaacctgagataacttgacttcacaataggaaattctgcct

SEQ ID NO: 155852 - DNA, 7571 bp, Homo sapiens
  Payload ID: 10613
  Gene Symbol: MEGF10
  Gene Name: multiple EGF-like-domains 10
  Uniprot ID: Q96KG7
  ENST ID: ENST00000503335
  CDS Start-End: 245-3667
actttcccggtgcgcaaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctgggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggtggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttcccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataaaaaa

SEQ ID NO: 155853 - DNA, 5707 bp, Homo sapiens
  Payload ID: 10614
  Gene Symbol: MEGF11
  Gene Name: multiple EGF-like-domains 11
  Uniprot ID: A6BM72
  ENST ID: ENST00000288745
  CDS Start-End: 160-3069
gcccgctgcccgccgcccggctcccggctgctcgcggccccctgctcctgcctggcgctctggccaggctcgggctccggaggacaggaccgcgcgactggccggccgatccctgggccggccgcgggagcagctatgctgtgactgtccaggaatcgtatgcacaccccttcgatcagatctattacacacgatgcacagacatcctcaactggttcaagtgcaccaggcaccgccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaattt

SEQ ID NO: 155854 - DNA, 3423 bp, Homo sapiens
  Payload ID: 10614
  Gene Symbol: MEGF11
  Gene Name: multiple EGF-like-domains 11
  ENST ID: ENST00000395614
  CDS Start-End: 1-3423
atggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagatttgtctcaaagtagcagccatgcccactgcttttccaattccagctaccacgcactggcatgtggggggcctgccaccagccaggccagcactctggacaggaacagccccaccaagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaa

SEQ ID NO: 155855 - DNA, 6163 bp, Homo sapiens
  Payload ID: 10614
  Gene Symbol: MEGF11
  Gene Name: multiple EGF-like-domains 11
  Uniprot ID: A6BM72
  ENST ID: ENST00000409699
  CDS Start-End: 174-3308
cgctcccggtgcccgctgcccgccgcccggctcccggctgctcgcggccccctgctcctgcctggcgctctggccaggctcgggctccggaggacaggaccgcgcgactggccggccgatccctgggccggccgcgggagcagcctcctttgttctcctgtgcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaatttaacaagaatgcctactgttgtgttgcaaatggaaaacgtgcttataatctacaccttaagtttaagggtagaactaacctacatcctgcttgggcactttgaacacctggaagaatgaaaattattctagtagatgtttgaaaataagtgaaaaacttgtatcaaatttttgatagacgagtctctttctttaaagtaataaatgtgagcaccatat

SEQ ID NO: 155856 - DNA, 864 bp, Homo sapiens
  Payload ID: 10614
  Gene Symbol: MEGF11
  Gene Name: multiple EGF-like-domains 11
  ENST ID: ENST00000455812
  CDS Start-End: 182-864
tgcttttccatcttccagtgtgtgacatcctttgtctcctattcctcttttctttggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgccc

SEQ ID NO: 155857 - DNA, 5914 bp, Homo sapiens
  Payload ID: 10614
  Gene Symbol: MEGF11
  Gene Name: multiple EGF-like-domains 11
  Uniprot ID: A6BM72
  ENST ID: ENST00000422354
  CDS Start-End: 142-3276
gcccgctgcccgccgcccggctcccggctgctcgcggccccctgctcctgcctggcgctctggccaggctcgggctccggaggacaggaccgcgcgactggccggccgatccctgggccggccgcgggagcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaattt

SEQ ID NO: 155858 - DNA, 3216 bp, Homo sapiens
  Payload ID: 10614
  Gene Symbol: MEGF11
  Gene Name: multiple EGF-like-domains 11
  ENST ID: ENST00000490495
  CDS Start-End: 127-1866
ggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgtaagccccacctcctggcctcccagccacttagaataccatgctgcggcctactggccactgtgggcattgtccagaccagcagggagggaggaatgcaggcagccccaggactggtggtacctgactcctgccccacgagaactgaggagctctgcaggggcagctccagacctgactggattcaggggattgacaagcccaaagtcctggaaggtcagggctgcaaggctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccagataagccttggatccaggagaggacagacaggaccagagctgagaggtgcttgtggaatggatagacgtcagaacacatacattatggacaaaggcttcaaaggcaggtggatgactcagctggagaacaaagtggcttcctgaggtggagtttccagcttgcccagcccttccccattctccagtcccagtagagatggggtacagaagagtccataattcaacacccttttctcaccacccagccaacacatacatgcactgctccatcctctgctcctgtatggaagatacttccccctgagcttagcccctccccacagacatcaacttctcttttatccatttaggatcatcccctgctccagagccaacaattgattccccaaaactttaaagtagccccgacttttctggtgaaaatgagaagaggcactatcaactggccgaggttcttttaggcattgaacttcaaggctctcctactgccctaactcagtcatgggatatccacaaaaaacttaagagcttagcctttttctctcagctgggcttagccccatagatgaaagacattccttgttaagggtaaggtgtagctgctgcagatacagtttgcctttagagatatggacaggagccctggataacaagacacgtagtgagggaaaacatcttgattggtatcaagagaagacaggggttgagtcctgactaaactatttactaacattaggaattatattagcaaattttctgagcttcagattcctcattctaaagtagaaacaacagtcctttctgcccagccctattcacgatgtaacaagtttcaaatgacctaattggaatgaagactatacgtgcta

SEQ ID NO: 155859 - DNA, 454 bp, Homo sapiens
  Payload ID: 10614
  Gene Symbol: MEGF11
  Gene Name: multiple EGF-like-domains 11
  ENST ID: ENST00000564573
  CDS Start-End: 1-91
gtgcctcccaggattctctggagctctctgcaaccaagctagcaagtggcagaaacaaattctgattccgacatgcatgctgaagggatgaaaagtgaaacaagcacagagatctgcatcagaagtggcaccatgtggtctgtgccgagtgccaagggtaaaggcagagaatgctgtgggagtgcagaggagctggctctggctggagatggcaacttccaagcccttctccccgtcatattcaggccaccatccctaatccctccccatatgctttcctgacttgacctcagaatccttcacaataccgactccaagaactgctaccactcagcaggagttgaaaagagatataaagcttatttgcattggtgttccaccctaccagctctttgtgggggaaaaaccctgatctgtaacatctgcagatttttaaaatataaatattcctacc

SEQ ID NO: 155860 - DNA, 2644 bp, Homo sapiens
  Payload ID: 10614
  Gene Symbol: MEGF11
  Gene Name: multiple EGF-like-domains 11
  ENST ID: ENST00000615866
  CDS Start-End: 160-2644
gcccgctgcccgccgcccggctcccggctgctcgcggccccctgctcctgcctggcgctctggccaggctcgggctccggaggacaggaccgcgcgactggccggccgatccctgggccggccgcgggagcagctatgctgtgactgtccaggaatcgtatgcacaccccttcgatcagatctattacacacgatgcacagacatcctcaactggttcaagtgcaccaggcaccgccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcag

SEQ ID NO: 155861 - DNA, 733 bp, Homo sapiens
  Payload ID: 10614
  Gene Symbol: MEGF11
  Gene Name: multiple EGF-like-domains 11
  ENST ID: ENST00000489275
  CDS Start-End: 1-353
atttgtctcaaagtagcagccatgcccactgcttttccaattccagctaccacgcactggcatgtggggggcctgccaccagccaggccagcactctggacaggaacagccccaccaagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccagataagccttggatccaggagaggacagacaggaccagagctgagaggtgcttgtggaatggatagacgtcagaacacatacattatggacaaaggcttcaaaggcaggtggatgactcagctggagaacaaagtggcttcctgaggtggagtttccagcttgcccagcccttccccattctccagtcccagtagagatggggtacagaagagtccataattcaacacccttttctcaccacccagccaacacatacatgcactgctccatcctctgctcctgtatggaagatacttccccctgagcttagcccctccccacagacatcaacttctcttttatccatttaggatcatcccctgctccagagccaacaattgattccccaaaactttaaagtagccccgacttttctggtgaaaatgagaagaggcactatcaactg

SEQ ID NO: 155862 - DNA, 2347 bp, Homo sapiens
  Payload ID: 10614
  Gene Symbol: MEGF11
  Gene Name: multiple EGF-like-domains 11
  ENST ID: ENST00000614417
  CDS Start-End: 1-1866
ggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgtaagccccacctcctggcctcccagccacttagaataccatgctgcggcctactggccactgtgggcattgtccagaccagcagggagggaggaatgcaggcagccccaggactggtggtacctgactcctgccccacgagaactgaggagctctgcaggggcagctccagacctgactggattcaggggattgacaagcccaaagtcctggaaggtcagggctgcaaggctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccag

SEQ ID NO: 155863 - DNA, 2883 bp, Homo sapiens
  Payload ID: 10614
  Gene Symbol: MEGF11
  Gene Name: multiple EGF-like-domains 11
  ENST ID: ENST00000614717
  CDS Start-End: 174-2883
cgctcccggtgcccgctgcccgccgcccggctcccggctgctcgcggccccctgctcctgcctggcgctctggccaggctcgggctccggaggacaggaccgcgcgactggccggccgatccctgggccggccgcgggagcagcctcctttgttctcctgtgcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcag

SEQ ID NO: 155864 - DNA, 740 bp, Homo sapiens
  Payload ID: 10614
  Gene Symbol: MEGF11
  Gene Name: multiple EGF-like-domains 11
  ENST ID: ENST00000562154
  CDS Start-End: 1-79
ctggaccccctacagctatgtgaacgtgttagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagatgccaactaaatgtcttcggaaatgtaaagcgtcattatccaaccaattagtacgagttaaattgattataaaatctgaaataaagttgatctacctgccccagaggcctcctgtcgttgcactagcaaggaatgccaccctgcacctgctggctttctgggggcacaaggaatgaaaatgatacgcagtgttaatattgtatggcactccaacctcaagagatctctgcctccaagagcagagaagccaagacaaatccctaacacatgggaactgcaagttggatcatccctctaggaagtctacaggtgaagccaaagatgaaaggtcaggtcctgccctaggtttaaatgccggaatgtgtgaaatagggggctttggaactctgtcacttgccactctgttgctcattaactgtgaccttagactggactgtgagctttccaaggctcagtttcctcatctgcaaggttgggataattttgcctgtcctattgtctaatgcctgtcctactgtctaacaaggttatcatgagtaaccaataaaatcaccaatgggaa

SEQ ID NO: 155865 - DNA, 454 bp, Homo sapiens; identical to SEQ ID NO: 155859
  Payload ID: 10614
  Gene Symbol: MEGF11
  Gene Name: multiple EGF-like-domains 11
  ENST ID: ENST00000622356
  CDS Start-End: 1-91

SEQ ID NO: 155866 - DNA, 4501 bp, Homo sapiens
  Payload ID: 10615
  Gene Symbol: MEGF6
  Gene Name: multiple EGF-like-domains 6
  Uniprot ID: O75095
  ENST ID: ENST00000294599
  CDS Start-End: 204-3893
gagaacttaaaggcgaggggcggggcgcgcccggcccagagcggctcccgggcggcgccgagcggagcggatcccggggctgggattgcgcgcccgcccggaacccagaaccagcccgagccgcctgccccgtcgcccggccgccggcttagggcgcagcgcggttggtcctcgccccctcccgcccgccggcctaccaggccatgggggcgtcccgggaccgcgggctggccgcgctctggtgccttgggctcctggggggcctggcgcgcgtcgcgggcacgcactaccgctacctctggaggggctgctacccatgtcacctgggccaggccggctaccccgtgagcgccggtgaccagaggccagatgtggacgaatgccgaacccacaacggtggctgccagcaccggtgcgtgaacaccccaggctcctacctctgtgagtgcaagcccggcttccggctccacactgacagcaggacctgcctggccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccggattgagatggaaatcgtgaacagctgtgaggccaacaacggcggctgctcccatggctgcagccacaccagtgctgggcccctgtgcacatgtccccgcggctacgagctggacacagatcagaggacctgcatcgatgtcgacgactgtgcagacagcccgtgctgccagcaggtgtgcaccaacaaccctggcgggtacgagtgcggctgctacgccggctaccggctcagtgccgatggctgcggctgtgaggatgtggatgagtgcgcctccagccgtggcggctgcgagcaccactgcaccaacctggccggctccttccagtgctcctgcgaggccggctaccggctgcacgaggaccgtaggggctgcagccccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagacttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagaagtgcctcccccgggacgtcagagctggctgccggcacagcggcggttgcctcaacgggggcctgtgtgacccgcacacgggccgctgcctctgcccagccggctggactggggacaagtgtcagagcccctgcctgcggggctggtttggagaggcctgtgcccagcgctgcagctgcccgcctggcgctgcctgccaccacgtcactggggcctgccgctgtccccctggcttcactggctccggctgcgagcagggatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcaccggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggcaacctc

SEQ ID NO: 155867 - DNA, 5455 bp, Homo sapiens
  Payload ID: 10615
  Gene Symbol: MEGF6
  Gene Name: multiple EGF-like-domains 6
  Uniprot ID: O75095
  ENST ID: ENST00000356575
  CDS Start-End: 228-4853
cgccggggcgagttcctgcagggtggacccggcgatcaggtctccgcggtgccactttgggcgcgggcgggaagccgggacgctccgcacctgcagcgaccttgggctccgcggagcgggcgcgggcacctgtggctgcgtcctatggcgcacgtggaggcggaggctccggggagccgccggggccgcctgtgagccggagagcggaggaggcaccggcgcgcacgatgtcgttccttgaagaggcgagggcagcggggcgcgcggtggtcctggcgttggtgctgctgctgctccccgccgtgcccgtgggcgccagcgttccgccgcggcccctgctcccgctgcagcccggcatgccccacgtgtgtgctgagcaggagctgaccctggtgggccgccgccagccgtgcgtgcaggccttaagccacacggtgccggtgtggaaggccggctgtgggtggcaggcgtggtgcgtgggtcatgagcggagaaccgtctactacatgggctacaggcaggtgtataccacggaggcccggaccgtgctcaggtgctgccgagggtggatgcagcagcccgacgaggagggctgcctctcggctgaatgcagcgccagcctctgttttcacggtggccgttgtgtgccaggctcagcccagccgtgtcactgtccccccggcttccagggaccccgctgtcagtatgatgtggacgaatgccgaacccacaacggtggctgccagcaccggtgcgtgaacaccccaggctcctacctctgtgagtgcaagcccggcttccggctccacactgacagcaggacctgcctggccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccggattgagatggaaatcgtgaacagctgtgaggccaacaacggcggctgctcccatggctgcagccacaccagtgctgggcccctgtgcacatgtccccgcggctacgagctggacacagatcagaggacctgcatcgatgtcgacgactgtgcagacagcccgtgctgccagcaggtgtgcaccaacaaccctggcgggtacgagtgcggctgctacgccggctaccggctcagtgccgatggctgcggctgtgaggatgtggatgagtgcgcctccagccgtggcggctgcgagcaccactgcaccaacctggccggctccttccagtgctcctgcgaggccggctaccggctgcacgaggaccgtaggggctgcagccccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagacttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagacctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgagaaggagtgcctcccccgggacgtcagagctggctgccggcacagcggcggttgcctcaacgggggcctgtgtgacccgcacacgggccgctgcctctgcccagccggctggactggggacaagtgtcagagcccctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggc

SEQ ID NO: 155868 - DNA, 4705 bp, Homo sapiens
  Payload ID: 10615
  Gene Symbol: MEGF6
  Gene Name: multiple EGF-like-domains 6
  ENST ID: ENST00000485002
  CDS Start-End: 10-3981
gcgcgcacgatgtcgttccttgaagaggcgagggcagcggggcgcgcggtggtcctggcgttggtgctgctgctgctccccgccgtgcccgtgggcgccagcgttccgccgcggcccctgctcccgctgcagcccggcatgccccacgtgtgtgctgagcaggagctgaccctggtgggccgccgccagccgtgcgtgcaggccttaagccacacggtgccggtgtggaaggccggctgtgggtggcaggcgtggtgcgtgggtcatgagcggagaaccgtctactacatgggctacaggcaggtgtataccacggaggcccggaccgtgctcaggtgctgccgagggtggatgcagcagcccgacgaggagggctgcctctcggatgtgggtgagtgtgccaacgccaacgggggctgtgcgggtcggtgccgggacaccgtggggggcttctactgccgctggcccccccccagccaccagctgcagggtgatggcgagacttgccaagatgtggacgaatgccgaacccacaacggtggctgccagcaccggtgcgtgaacaccccaggctcctacctctgtgagtgcaagcccggcttccggctccacactgacagcaggacctgcctggccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccggattgagatggaaatcgtgaacagctgtgaggccaacaacggcggctgctcccatggctgcagccacaccagtgctgggcccctgtgcacatgtccccgcggctacgagctggacacagatcagaggacctgcatcgatgtcgacgactgtgcagacagcccgtgctgccagcaggtgtgcaccaacaaccctggcgggtacgagtgcggctgctacgccggctaccggctcagtgccgatggctgcggctgtgaggatgtggatgagtgcgcctccagccgtggcggctgcgagcaccactgcaccaacctggccggctccttccagtgctcctgcgaggccggctaccggctgcacgaggaccgtaggggctgcagccccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagacttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagacctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgagaaggagtgcctcccccgggacgtcagagctggctgccggcacagcggcggttgcctcaacgggggcctgtgtgacccgcacacgggccgctgcctctgcccagccggctggactggggacaagtgtcagagcccctgtgccaagggcacattcgggcctcactgtgaggggcgctgtgcctgccggtggggaggcccctgccaccttgccaccggggcctgcctctgccctccggggtggcggggggctccaggtgtgagaatgcctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaagcgggcacactgcccgcctccagcagacc

SEQ ID NO: 155869 - DNA, 743 bp, Homo sapiens
  Payload ID: 10615
  Gene Symbol: MEGF6
  Gene Name: multiple EGF-like-domains 6
  ENST ID: ENST00000491842
  CDS Start-End: 1-743
gtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtcctta

SEQ ID NO: 155870 - DNA, 9549 bp, Homo sapiens
  Payload ID: 10616
  Gene Symbol: MEGF8
  Gene Name: multiple EGF-like-domains 8
  Uniprot ID: Q7Z7M0
  ENST ID: ENST00000251268
  CDS Start-End: 1-8538
atggccctgggcaaggttctggccatggcactggttttggccttggccgtgctggggtcgctgtcccctggggcccgggcgggggactgcaaggggcagcggcaggtgctgcgggaggcgccaggcttcgtgacggatggtgcgggcaactacagcgtcaatggcaactgcgagtggctcatcgaggccccaagcccccagcaccggatcctgctggacttccttttcctggacacagagtgcacgtatgactacctgttcgtgtatgacggtgactccccgcgagggccgctgcttgccagtctaagtgggagcacccgacctccgcccatcgaagcttcctcaggcaagatgctgctgcacctcttcagtgatgccaactacaacctgctgggctttaacgcctcattccgcttctccctgtgcccgggtggctgccagagccacgggcagtgccagccaccgggtgtgtgtgcctgcgagccgggctgggggggtcctgactgtggcctgcaggagtgctcagcctactgtggcagccacggcacctgcgcctcgcccctgggaccatgccgctgtgagcctggcttcttgggacgtgcctgtgacctgcacctgtgggagaaccagggggctgggtggtggcacaacgtgagtgccagggaccctgccttctctgcccgtattggggcagctggcgccttcctgtccccaccagggctgctggcagttttcggaggccaggacctcaacaatgccctgggtgacctcgtcctatacaacttctccgccaacacctgggagtcttgggacctgagtcctgccccggctgcccgtcactcccatgtggccgtggcctgggccggctccctggtactgatgggtggtgagctggctgacggctcgctcaccaacgacgtgtgggccttcagtccactgggcaggggccactgggagctcctggcaccacctgcctccagctcctcggggcccccaggcctggcaggtcacgcggctgccctggtggatgatgtctggctatatgtgtctggaggccgcaccccgcacgacctcttctcctctggcctcttccgtttccgccttgacagcaccagcgggggctattgggagcaggtgattccggcaggcggacggccccctgctgccactggccactccatggtgttccatgccccctcccgtgccctgctggtccatggtggacaccggccctccactgcccggttctctgtgcgagtgaactccactgagcttttccacgtggatcggcatgtgtggacgacgctgaaggggcgggatgggcttcagggcccaagggagcgagccttccacacagccagtgttctgggcaattacatggtggtctatgggggcaatgtgcacacccattaccaggaggaaaagtgctacgaagatggcatcttcttctaccaccttggctgccatcaatgggtgtcaggagctgagcttgccccgccaggaacccctgagggccgagcagcgcctcccagtggtcggtactcacatgtagctgcggtgcttggtggcagcgtcctgttggtggctggggggtacagcggccggccccgtggggacttgatggcgtacaaggtgcccccctttgtgttccaggcacctgcccctgactaccacttggactactgctccatgtacacagaccacagcgtctgctcccgggacccggaatgcagttggtgccaaggagcctgccaagctgcaccccctcctgggacccccttgggggcttgtccagccgccagctgcctgggcctgggccgcctcctgggtgactgccaggcctgcctggccttcagcagccccacagcccctccacggggacctggcaccctgggctggtgcgtgcacaatgagagctgcctccctaggcctgagcaggcccgctgccgaggggagcagatctcaggcactgtgggctggtgggggcctgcgcctgtcttcgtcacgtccctggaggcctgcgtcacccagagcttcctgcctggcctgcacttgctcacctttcagcagccgcccaatacctcccagcctgacaaggtctcaattgtccgcagcacgaccatcaccctaacacccagcgcagagacagatgtgtccctggtctaccgtggcttcatctacccaatgctgcctggagggccaggtggaccaggggctgaggacgtggccgtgtggacgcgggcccagcgcctacacgtcctggcccggatggcccgtggccctgacacggagaacatggaggaggtggggcgctgggtggctcatcaggagaaggagacgcggcggctgcagcgccctgggtctgctcgcctcttccctctgcctgggcgggaccacaagtatgcagtagagatccagggccagctcaatggctcggcaggccctgggcacagcgagctaactctgctgtgggatcggactggtgtgccaggaggcagcgagatctccttcttcttcctggagccctaccgctcgtcgtcctgcacctcctattcttcctgcctgggctgcttggcagaccagggctgtggctggtgcctgaccagtgccacctgccacctgcgccagggcggagcccattgcggggatgacggggctggtgggtccctgctggtgctggtgcctaccctctgcccactctgcgaggagcatcgggactgccacgcctgcacccaggaccccttctgtgagtggcatcagagcaccagccgcaaaggggacgcggcatgcagccggcggggccggggtcggggtgccctgaagagtccagaggagtgtcccccgctctgcagccagcgactgacctgtgaggactgcctggccaactctagccagtgcgcctggtgccagtccacccacacctgcttcctgtttgctgcctacttggcccggtacccacacgggggctgtcgaggctgggacgacagtgtacactcggagccacggtgccggagctgcgatggcttcctgacctgccatgagtgtctgcagagccacgagtgtggctggtgtggcaatgaggacaaccccacactgggacggtgcctacagggggacttctcagggcccctcggtgggggtaactgctccctgtgggtgggggagggcctggggcttcccgtggccctccctgcccgctgggcatacgcccgctgtcctgacgtggatgagtgtcgcctgggcctggcccggtgccacccgcgggcgacctgcctgaacacgcccctcagctacgagtgtcactgccagcggggctaccagggtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagcgagatcgtatgaggaatgtgcgtggctcatctcggggtctgggccaagttcctggggagcagcctgggtcatgggggttccgggaagtcaggaagaagatggctctgtgggctgctcttgctggtacaggaggtttcctggaggaaatctcacctcacctgaaggagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaaatgccagtgtaatggccacgcggacacatgtaacgagcaggatgggacgggctgtccatgtcagaataacacagagacgggcacatgccagggcagctcccccagtgaccgtcgagactgctacaagtaccagtgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctc

SEQ ID NO: 155871 - DNA, 10966 bp, Homo sapiens
  Payload ID: 10616
  Gene Symbol: MEGF8
  Gene Name: multiple EGF-like-domains 8
  Uniprot ID: Q7Z7M0
  ENST ID: ENST00000334370
  CDS Start-End: 636-8972
ggccgctctggcccaagcgtcccctcgtctctctgatctggcccatccggcttcggagggaggcgagggtgggtgagcaaagggattgggtctgtggggtccaggcccgaacccctgaagacgggctccgcccccggcacccgctcgcgccccgcccccggctggaggagtctctcctggaccatccgaacctagcctgtcccggcccgcagcctctatggaggctcctgccgggccgtagagcccttcgccccctggggacccacccgtctataaggtccgtttggcctgcagcagcctgagtccgtaatgctgggcactgttcatgggatcggccccctatggagccctgtgtctataggggactcctacggtccctagggttcggccccgtccataatgactccatatacagggccttccatcgctctatagggctcagccctcggcttccagagcctgtcagcagtggccgtacccttcgccgggactgccgggtctccgggacctcttcgatctacaaggtcatgttatgcctatagaggtcgcatttgcagggcctcaccccgggtagagggtcctctccaggtttttacggcctgtccccgctctaagggtcagtgcaggaggcggcgatggccctgggcaaggttctggccatggcactggttttggccttggccgtgctggggtcgctgtcccctggggcccgggcgggggactgcaaggggcagcggcaggtgctgcgggaggcgccaggcttcgtgacggatggtgcgggcaactacagcgtcaatggcaactgcgagtggctcatcgaggccccaagcccccagcaccggatcctgctggacttccttttcctggacacagagtgcacgtatgactacctgttcgtgtatgacggtgactccccgcgagggccgctgcttgccagtctaagtgggagcacccgacctccgcccatcgaagcttcctcaggcaagatgctgctgcacctcttcagtgatgccaactacaacctgctgggctttaacgcctcattccgcttctccctgtgcccgggtggctgccagagccacgggcagtgccagccaccgggtgtgtgtgcctgcgagccgggctgggggggtcctgactgtggcctgcaggagtgctcagcctactgtggcagccacggcacctgcgcctcgcccctgggaccatgccgctgtgagcctggcttcttgggacgtgcctgtgacctgcacctgtgggagaaccagggggctgggtggtggcacaacgtgagtgccagggaccctgccttctctgcccgtattggggcagctggcgccttcctgtccccaccagggctgctggcagttttcggaggccaggacctcaacaatgccctgggtgacctcgtcctatacaacttctccgccaacacctgggagtcttgggacctgagtcctgccccggctgcccgtcactcccatgtggccgtggcctgggccggctccctggtactgatgggtggtgagctggctgacggctcgctcaccaacgacgtgtgggccttcagtccactgggcaggggccactgggagctcctggcaccacctgcctccagctcctcggggcccccaggcctggcaggtcacgcggctgccctggtggatgatgtctggctatatgtgtctggaggccgcaccccgcacgacctcttctcctctggcctcttccgtttccgccttgacagcaccagcgggggctattgggagcaggtgattccggcaggcggacggccccctgctgccactggccactccatggtgttccatgccccctcccgtgccctgctggtccatggtggacaccggccctccactgcccggttctctgtgcgagtgaactccactgagcttttccacgtggatcggcatgtgtggacgacgctgaaggggcgggatgggcttcagggcccaagggagcgagccttccacacagccagtgttctgggcaattacatggtggtctatgggggcaatgtgcacacccattaccaggaggaaaagtgctacgaagatggcatcttcttctaccaccttggctgccatcaatgggtgtcaggagctgagcttgccccgccaggaacccctgagggccgagcagcgcctcccagtggtcggtactcacatgtagctgcggtgcttggtggcagcgtcctgttggtggctggggggtacagcggccggccccgtggggacttgatggcgtacaaggtgcccccctttgtgttccaggcacctgcccctgactaccacttggactactgctccatgtacacagaccacagcgtctgctcccgggacccggaatgcagttggtgccaaggagcctgccaagctgcaccccctcctgggacccccttgggggcttgtccagccgccagctgcctgggcctgggccgcctcctgggtgactgccaggcctgcctggccttcagcagccccacagcccctccacggggacctggcaccctgggctggtgcgtgcacaatgagagctgcctccctaggcctgagcaggcccgctgccgaggggagcagatctcaggcactgtgggctggtgggggcctgcgcctgtcttcgtcacgtccctggaggcctgcgtcacccagagcttcctgcctggcctgcacttgctcacctttcagcagccgcccaatacctcccagcctgacaaggaggaggtggggcgctgggtggctcatcaggagaaggagacgcggcggctgcagcgccctgggtctgctcgcctcttccctctgcctgggcgggaccacaagtatgcagtagagatccagggccagctcaatggctcggcaggccctgggcacagcgagctaactctgctgtgggatcggactggtgtgccaggaggcagcgagatctccttcttcttcctggagccctaccgctcgtcgtcctgcacctcctattcttcctgcctgggctgcttggcagaccagggctgtggctggtgcctgaccagtgccacctgccacctgcgccagggcggagcccattgcggggatgacggggctggtgggtccctgctggtgctggtgcctaccctctgcccactctgcgaggagcatcgggactgccacgcctgcacccaggaccccttctgtgagtggcatcagagcaccagccgcaaaggggacgcggcatgcagccggcggggccggggtcggggtgccctgaagagtccagaggagtgtcccccgctctgcagccagcgactgacctgtgaggactgcctggccaactctagccagtgcgcctggtgccagtccacccacacctgcttcctgtttgctgcctacttggcccggtacccacacgggggctgtcgaggctgggacgacagtgtacactcggagccacggtgccggagctgcgatggcttcctgacctgccatgagtgtctgcagagccacgagtgtggctggtgtggcaatgaggacaaccccacactgggacggtgcctacagggggacttctcagggcccctcggtgggggtaactgctccctgtgggtgggggagggcctggggcttcccgtggccctccctgcccgctgggcatacgcccgctgtcctgacgtggatgagtgtcgcctgggcctggcccggtgccacccgcgggcgacctgcctgaacacgcccctcagctacgagtgtcactgccagcggggctaccagggtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagcgagatcgtatgaggaatgtgcgtggctcatctcggggtctgggccaagttcctggggagcagcctgggtcatgggggttccgggaagtcaggaagaagatggctctgtgggctgctcttgctggtacaggaggtttcctggaggaaatctcacctcacctgaaggagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaaatgccagtgtaatggccacgcggacacatgtaacgagcaggatgggacgggctgtccatgtcagaataacacagagacgggcacatgccagggcagctcccccagtgaccgtcgagactgctacaagtaccagtgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaaaaaaaatttaagaggtcactcagttgtgctgtggagaatggaccggagggacaagaggggcagcagggatggtgggctggagtagggtgctggcaatgagggagtctggctcagatgtgggatgtgtatggaagaatataaatgatggtgtggatgtcagggtgagggaggagacaaaaccacgatgacccctagctttgtggcctgaactgtgggtggctgaggggatcgttaattgaatggggcagactgaggcttgtgaggaagatcagagtctggttcttgacatgagatgcccttcagacatctcttcactcaggtccaactagggatacagaaacactgaatatttcaacagcagaaattgaatggggggattgatagcgctggcgagggaagcagctggaaagagacagatggcaccctgagacagcccagaggtgaataggacccccaggctgcagggataaagctcagtggtggtgttacctcaccggggaccagggtcacacagcaaagctggaacaacagaggcgtgttgtgggggagcctcagaggggacaaaacctctgcctgagatcccaccccaggtgggcatgggggccactgaggttggggatgaaaatgccggtaccgtcagtgcacagccctgttccagacagtgctgcctggaagatttctgggctctcctgaggcgccaccccgcacctgagccacctccttggactcctgtcctctaccccttgaggacctccctcccttctaccctagctgtcttcttgaacttgggactctcctttcccaagacttccatcactagctcctggagggactggactttgcatcttcccttcgcgtggagcctcagtgtgagaggccctagccaatgcgtgcatgtcagaggtggtggggaccacatcagaagaagaggggggtgatgaaattaacaaataaaaagtatggggaaaaccca

SEQ ID NO: 155872 - DNA, 11034 bp, Homo sapiens
  Payload ID: 10616
  Gene Symbol: MEGF8
  Gene Name: multiple EGF-like-domains 8
  ENST ID: ENST00000378073
  CDS Start-End: 7721-9040
ggccgctctggcccaagcgtcccctcgtctctctgatctggcccatccggcttcggagggaggcgagggtgggtgagcaaagggattgggtctgtggggtccaggcccgaacccctgaagacgggctccgcccccggcacccgctcgcgccccgcccccggctggaggagtctctcctggaccatccgaacctagcctgtcccggcccgcagcctctatggaggctcctgccgggccgtagagcccttcgccccctggggacccacccgtctataaggtccgtttggcctgcagcagcctgagtccgtaatgctgggcactgttcatgggatcggccccctatggagccctgtgtctataggggactcctacggtccctagggttcggccccgtccataatgactccatatacagggccttccatcgctctatagggctcagccctcggcttccagagcctgtcagcagtggccgtacccttcgccgggactgccgggtctccgggacctcttcgatctacaaggtcatgttatgcctatagaggtcgcatttgcagggcctcaccccgggtagagggtcctctccaggtttttacggcctgtccccgctctaagggtcagtgcaggaggcggcgatggccctgggcaaggttctggccatggcactggttttggccttggccgtgctggggtcgctgtcccctggggcccgggcgggggactgcaaggggcagcggcaggtgctgcgggaggcgccaggcttcgtgacggatggtgcgggcaactacagcgtcaatggcaactgcgagtggctcatcgaggccccaagcccccagcaccggatcctgctggacttccttttcctggacacagagtgcacgtatgactacctgttcgtgtatgacggtgactccccgcgagggccgctgcttgccagtctaagtgggagcacccgacctccgcccatcgaagcttcctcaggcaagatgctgctgcacctcttcagtgatgccaactacaacctgctgggctttaacgcctcattccgcttctccctgtgcccgggtggctgccagagccacgggcagtgccagccaccgggtgtgtgtgcctgcgagccgggctgggggggtcctgactgtggcctgcaggagtgctcagcctactgtggcagccacggcacctgcgcctcgcccctgggaccatgccgctgtgagcctggcttcttgggacgtgcctgtgacctgcacctgtgggagaaccagggggctgggtggtggcacaacgtgagtgccagggaccctgccttctctgcccgtattggggcagctggcgccttcctgtccccaccagggctgctggcagttttcggaggccaggacctcaacaatgccctgggtgacctcgtcctatacaacttctccgccaacacctgggagtcttgggacctgagtcctgccccggctgcccgtcactcccatgtggccgtggcctgggccggctccctggtactgatgggtggtgagctggctgacggctcgctcaccaacgacgtgtgggccttcagtccactgggcaggggccactgggagctcctggcaccacctgcctccagctcctcggggcccccaggcctggcaggtcacgcggctgccctggtggatgatgtctggctatatgtgtctggaggccgcaccccgcacgacctcttctcctctggcctcttccgtttccgccttgacagcaccagcgggggctattgggagcaggtgattccggcaggcggacggccccctgctgccactggccactccatggtgttccatgccccctcccgtgccctgctggtccatggtggacaccggccctccactgcccggttctctgtgcgagtgaactccactgagcttttccacgtggatcggcatgtgtggacgacgctgaaggggcgggatgggcttcagggcccaagggagcgagccttccacacagccagtgttctgggcaattacatggtggtctatgggggcaatgtgcacacccattaccaggaggaaaagtgctacgaagatggcatcttcttctaccaccttggctgccatcaatgggtgtcaggagctgagcttgccccgccaggaacccctgagggccgagcagcgcctcccagtggtcggtactcacatgtagctgcggtgcttggtggcagcgtcctgttggtggctggggggtacagcggccggccccgtggggacttgatggcgtacaaggtgcccccctttgtgttccaggcacctgcccctgactaccacttggactactgctccatgtacacagaccacagcgtctgctcccgggacccggaatgcagttggtgccaaggagcctgccaagctgcaccccctcctgggacccccttgggggcttgtccagccgccagctgcctgggcctgggccgcctcctgggtgactgccaggcctgcctggccttcagcagccccacagcccctccacggggacctggcaccctgggctggtgcgtgcacaatgagagctgcctccctaggcctgagcaggcccgctgccgaggggagcagatctcaggcactgtgggctggtgggggcctgcgcctgtcttcgtcacgtccctggaggcctgcgtcacccagagcttcctgcctggcctgcacttgctcacctttcagcagccgcccaatacctcccagcctgacaaggtctcaattgtccgcagcacgaccatcaccctaacacccagcgcagagacagatgtgtccctggtctaccgtggcttcatctacccaatgctgcctggagggccaggtggaccaggggctgaggacgtggccgtgtggacgcgggcccagcgcctacacgtcctggcccggatggcccgtggccctgacacggagaacatggaggaggtggggcgctgggtggctcatcaggagaaggagacgcggcggctgcagcgccctgggtctgctcgcctcttccctctgcctgggcgggaccacaagtatgcagtagagatccagggccagctcaatggctcggcaggccctgggcacagcgagctaactctgctgtgggatcggactggtgtgccaggaggcagcgagatctccttcttcttcctggagccctaccgctcgtcgtcctgcacctcctattcttcctgcctgggctgcttggcagaccagggctgtggctggtgcctgaccagtgccacctgccacctgcgccagggcggagcccattgcggggatgacggggctggtgggtccctgctggtgctggtgcctaccctctgcccactctgcgaggagcatcgggactgccacgcctgcacccaggaccccttctgtgagtggcatcagagcaccagccgcaaaggggacgcggcatgcagccggcggggccggggtcggggtgccctgaagagtccagaggagtgtcccccgctctgcagccagcgactgacctgtgaggactgcctggccaactctagccagtgcgcctggtgccagtccacccacacctgcttcctgtttgctgcctacttggcccggtacccacacgggggctgtcgaggctgggacgacagtgtacactcggagccacggtgccggagctgcgatggcttcctgacctgccatgagtgtctgcagagccacgagtgtggctggtgtggcaatgaggacaaccccacactgggacggtgcctacagggggacttctcagggcccctcggtgggggtaactgctccctgtgggtgggggagggcctggggcttcccgtggccctccctgcccgctgggcatacgcccgctgtcctgacgtggatgagtgtcgcctgggcctggcccggtgccacccgcgggcgacctgcctgaacacgcccctcagctacgagtgtcactgccagcggggctaccagggtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagcgagatcgtatgaggaatgtgcgtggctcatctcggggtctgggccaagttcctggggagcagcctgggtcatgggggttccgggaagtcaggaagaagatggctctgtgggctgctcttgctggtacaggaggtttcctggaggaaatctcacctcacctgaaggagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaatgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaaaaaaaatttaagaggtcactcagttgtgctgtggagaatggaccggagggacaagaggggcagcagggatggtgggctggagtagggtgctggcaatgagggagtctggctcagatgtgggatgtgtatggaagaatataaatgatggtgtggatgtcagggtgagggaggagacaaaaccacgatgacccctagctttgtggcctgaactgtgggtggctgaggggatcgttaattgaatggggcagactgaggcttgtgaggaagatcagagtctggttcttgacatgagatgcccttcagacatctcttcactcaggtccaactagggatacagaaacactgaatatttcaacagcagaaattgaatggggggattgatagcgctggcgagggaagcagctggaaagagacagatggcaccctgagacagcccagaggtgaataggacccccaggctgcagggataaagctcagtggtggtgttacctcaccggggaccagggtcacacagcaaagctggaacaacagaggcgtgttgtgggggagcctcagaggggacaaaacctctgcctgagatcccaccccaggtgggcatgggggccactgaggttggggatgaaaatgccggtaccgtcagtgcacagccctgttccagacagtgctgcctggaagatttctgggctctcctgaggcgccaccccgcacctgagccacctccttggactcctgtcctctaccccttgaggacctccctcccttctaccctagctgtcttcttgaacttgggactctcctttcccaagacttccatcactagctcctggagggactggactttgcatcttcccttcgcgtggagcctcagtgtgagaggccctagccaatgcgtgcatgtcagaggtggtggggaccacatcagaagaagaggggggtgatgaaattaacaaataaaaagtatggggaaaaccca

SEQ ID NO: 155873 - DNA, 2691 bp, Homo sapiens
  Payload ID: 10616
  Gene Symbol: MEGF8
  Gene Name: multiple EGF-like-domains 8
  ENST ID: ENST00000593647
  CDS Start-End: 1-537
aactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaatgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaaaaaaaa

SEQ ID NO: 155874 - DNA, 225 bp, Homo sapiens
  Payload ID: 10616
  Gene Symbol: MEGF8
  Gene Name: multiple EGF-like-domains 8
  ENST ID: ENST00000598762
  CDS Start-End: 1-212
gccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggtggtggggaccacatcagaagaagaggggggtgatgaaattaacaaataaaaagtatggggaa

SEQ ID NO: 155875 - DNA, 6298 bp, Homo sapiens
  Payload ID: 10617
  Gene Symbol: MEGF9
  Gene Name: multiple EGF-like-domains 9
  Uniprot ID: Q9H1U4
  ENST ID: ENST00000373930
  CDS Start-End: 113-1921
agagggaggtggcgatggtgcgcccggtggcggtggcggcggcggttgcggaggcttccttggtcggattgcaacgaggagaagatgactgaccaaccgactggctgaatgaatgaatggcggagccgagcgcgccatgaggagcctgccgagcctgggcggcctcgccctgttgtgctgcgccgccgccgccgccgccgccgccgtcgcctcagccgcctcggcggggaatgtcaccggtggcggcggggccgcggggcaggtggacgcgtcgccgggccccgggttgcggggcgagcccagccaccccttccctagggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttactgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 155876 - DNA, 2761 bp, Homo sapiens
  Payload ID: 10618
  Gene Symbol: MEN1
  Gene Name: multiple endocrine neoplasia I
  Uniprot ID: O00255
  ENST ID: ENST00000312049
  CDS Start-End: 111-1943
ggtgtccggagccgcggacctagagatcccagaagccacagcgcagcggcccggcccgccactatttccaggctcagcggggcaggggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaa

SEQ ID NO: 155877 - DNA, 3148 bp, Homo sapiens
  Payload ID: 10618
  Gene Symbol: MEN1
  Gene Name: multiple endocrine neoplasia I
  Uniprot ID: O00255
  ENST ID: ENST00000315422
  CDS Start-End: 498-2330
caatccctgagtatctcgggaaggaggtgtccggagccgcggacctagagatcccagaagccacagcgcagcggcccggcccgccactatttccaggctcagcggggcaggggtgggcccagactccacttcccggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaa

SEQ ID NO: 155878 - DNA, 3162 bp, Homo sapiens
  Payload ID: 10618
  Gene Symbol: MEN1
  Gene Name: multiple endocrine neoplasia I
  Uniprot ID: O00255
  ENST ID: ENST00000337652
  CDS Start-End: 505-2352
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagagtaggcatctttatatgttaacagacactgatacccagctaaagcggctgaacacatttactctctggcagtgtttaaaagtatctgtttttctcatattgttttattttaattttttctggatcaagcaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgtt

SEQ ID NO: 155879 - DNA, 1871 bp, Homo sapiens
  Payload ID: 10618
  Gene Symbol: MEN1
  Gene Name: multiple endocrine neoplasia I
  Uniprot ID: O00255
  ENST ID: ENST00000377313
  CDS Start-End: 24-1871
gccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctga

SEQ ID NO: 155880 - DNA, 2868 bp, Homo sapiens
  Payload ID: 10618
  Gene Symbol: MEN1
  Gene Name: multiple endocrine neoplasia I
  ENST ID: ENST00000377316
  CDS Start-End: 377-2044
ctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggtgagcagaggctgaagagggtggggaagcaggggagctgtgcgtgtgtcggggcgggtggaaccttagcggaccctgggaggaggctccccggccgaacctgcccgaccctccctcccccggcttgccttgcaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaatataaa

SEQ ID NO: 155881 - DNA, 2614 bp, Homo sapiens
  Payload ID: 10618
  Gene Symbol: MEN1
  Gene Name: multiple endocrine neoplasia I
  Uniprot ID: O00255
  ENST ID: ENST00000377321
  CDS Start-End: 69-1796
gggcggcgtgcgccgcggtgcctagtgtgggatgtaagcgcggaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaa

SEQ ID NO: 155882 - DNA, 3150 bp, Homo sapiens
  Payload ID: 10618
  Gene Symbol: MEN1
  Gene Name: multiple endocrine neoplasia I
  Uniprot ID: O00255
  ENST ID: ENST00000377326
  CDS Start-End: 500-2332
cggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggtgagcagaggctgaagagggtggggaagcaggggagctgtgcgtgtgtcggggcgggtggaaccttagcggaccctgggaggaggctccccggccgaacctgcccgaccctccctcccccggcttgccttgcaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaa

SEQ ID NO: 155883 - DNA, 3155 bp, Homo sapiens
  Payload ID: 10618
  Gene Symbol: MEN1
  Gene Name: multiple endocrine neoplasia I
  Uniprot ID: O00255
  ENST ID: ENST00000394374
  CDS Start-End: 498-2345
caatccctgagtatctcgggaaggaggtgtccggagccgcggacctagagatcccagaagccacagcgcagcggcccggcccgccactatttccaggctcagcggggcaggggtgggcccagactccacttcccggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgtt

SEQ ID NO: 155884 - DNA, 3034 bp, Homo sapiens
  Payload ID: 10618
  Gene Symbol: MEN1
  Gene Name: multiple endocrine neoplasia I
  Uniprot ID: O00255
  ENST ID: ENST00000394376
  CDS Start-End: 377-2224
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagacaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgtt

SEQ ID NO: 155885 - DNA, 816 bp, Homo sapiens
  Payload ID: 10618
  Gene Symbol: MEN1
  Gene Name: multiple endocrine neoplasia I
  ENST ID: ENST00000424912
  CDS Start-End: 377-816
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagacaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcat

SEQ ID NO: 155886 - DNA, 922 bp, Homo sapiens
  Payload ID: 10618
  Gene Symbol: MEN1
  Gene Name: multiple endocrine neoplasia I
  ENST ID: ENST00000450708
  CDS Start-End: 80-922
gacttcatgtcccagcaggctccgggcggcgtgcgccgcggtgcctagtgtgggatgccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttaggg

SEQ ID NO: 155887 - DNA, 944 bp, Homo sapiens
  Payload ID: 10618
  Gene Symbol: MEN1
  Gene Name: multiple endocrine neoplasia I
  ENST ID: ENST00000429702
  CDS Start-End: 505-944
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagagtaggcatctttatatgttaacagacactgatacccagctaaagcggctgaacacatttactctctggcagtgtttaaaagtatctgtttttctcatattgttttattttaattttttctggatcaagcaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcat

SEQ ID NO: 155888 - DNA, 870 bp, Homo sapiens
  Payload ID: 10618
  Gene Symbol: MEN1
  Gene Name: multiple endocrine neoplasia I
  ENST ID: ENST00000413626
  CDS Start-End: 88-870
gcgcggaggtgggcgagggggaccgaggccaggactctccttggggtttgggggcttgacctgggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcag

SEQ ID NO: 155889 - DNA, 1107 bp, Homo sapiens
  Payload ID: 10618
  Gene Symbol: MEN1
  Gene Name: multiple endocrine neoplasia I
  ENST ID: ENST00000440873
  CDS Start-End: 69-1107
gggcggcgtgcgccgcggtgcctagtgtgggatgtaagcgcggaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactg

SEQ ID NO: 155890 - DNA, 2183 bp, Homo sapiens
  Payload ID: 10619
  Gene Symbol: MINPP1
  Gene Name: multiple inositol-polyphosphate phosphatase 1
  Uniprot ID: Q9UNW1
  ENST ID: ENST00000371994
  CDS Start-End: 42-980
atctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgacttta

SEQ ID NO: 155891 - DNA, 2415 bp, Homo sapiens
  Payload ID: 10619
  Gene Symbol: MINPP1
  Gene Name: multiple inositol-polyphosphate phosphatase 1
  Uniprot ID: Q9UNW1
  ENST ID: ENST00000371996
  CDS Start-End: 42-1505
atctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgacttta

SEQ ID NO: 155892 - DNA, 2215 bp, Homo sapiens
  Payload ID: 10619
  Gene Symbol: MINPP1
  Gene Name: multiple inositol-polyphosphate phosphatase 1
  Uniprot ID: Q9UNW1
  ENST ID: ENST00000536010
  CDS Start-End: 373-1233
gcgttttgtgctgctgtcagtagtttttgtccaaagcagaatctttgtaaagtaatacagagttgggaaggttaattgagaaaataaaatactctgtttagactttggcttagagtgaaaaaatagattccatatgttgaattctctctcaccttgtaagtagaaactttgctgatttttagtttgctttctaaagttttccgtgcctgacagaaacagtacttattaatgtatgatgcaatttcattgcgtagcatctctacaacacatttaatcttcaatctctatttctttagccttttctagctattctcatgcgttacagccattataaatggggaataattttaccccaagagtttcctgaccaatatgtgcttatttcagctgtgcggattagtaagatatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagc

SEQ ID NO: 155893 - DNA, 7722 bp, Homo sapiens
  Payload ID: 10620
  Gene Symbol: MPDZ
  Gene Name: multiple PDZ domain protein
  Uniprot ID: O75970
  ENST ID: ENST00000319217
  CDS Start-End: 249-6461
ccgcgggattaagtttctcagtcacgcgtgagtgtctgtgcgttttgatccgaagctcctcgccgggtcgttacttcagaagagaagacagtgagcgtgggcgaggcgaggcatccagaggccccggcgacccctgctccccagtcctccgccccctcgcgtcgcggccctgggcgggcgccgcgagccggagttccattttaattgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgacttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataa

SEQ ID NO: 155894 - DNA, 7589 bp, Homo sapiens
  Payload ID: 10620
  Gene Symbol: MPDZ
  Gene Name: multiple PDZ domain protein
  Uniprot ID: O75970
  ENST ID: ENST00000381022
  CDS Start-End: 223-6336
cgtgagtgtctgtgcgttttgatccgaagctcctcgccgggtcgttacttcagaagagaagacagtgagcgtgggcgaggcgaggcatccagaggccccggcgacccctgctccccagtcctccgccccctcgcgtcgcggccctgggcgggcgccgcgagccggagttccattttaattgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaagggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgacttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgc

SEQ ID NO: 155895 - DNA, 786 bp, Homo sapiens
  Payload ID: 10620
  Gene Symbol: MPDZ
  Gene Name: multiple PDZ domain protein
  ENST ID: ENST00000433359
  CDS Start-End: 212-786
ttttaactacatatgtatgcatctcacattcagcacaagacattgacatttgttaacaccattgtaaaaagatgccgcggcgtatgcttcacattctagattttctgcagcacctgctgacgatcgagcccccttttatgtaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccg

SEQ ID NO: 155896 - DNA, 581 bp, Homo sapiens
  Payload ID: 10620
  Gene Symbol: MPDZ
  Gene Name: multiple PDZ domain protein
  ENST ID: ENST00000437441
  CDS Start-End: 1-239
tttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagagtcagtgtcccatttctgtacaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcac

SEQ ID NO: 155897 - DNA, 6262 bp, Homo sapiens
  Payload ID: 10620
  Gene Symbol: MPDZ
  Gene Name: multiple PDZ domain protein
  Uniprot ID: O75970
  ENST ID: ENST00000447879
  CDS Start-End: 44-6157
tgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaagggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaa

SEQ ID NO: 155898 - DNA, 2303 bp, Homo sapiens
  Payload ID: 10620
  Gene Symbol: MPDZ
  Gene Name: multiple PDZ domain protein
  ENST ID: ENST00000438511
  CDS Start-End: 1-1836
aataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaact

SEQ ID NO: 155899 - DNA, 2385 bp, Homo sapiens
  Payload ID: 10620
  Gene Symbol: MPDZ
  Gene Name: multiple PDZ domain protein
  ENST ID: ENST00000542806
  CDS Start-End: 1-103
atctgcaagcaaaatctcacaagatgtggacaaagaggatgagtttggttacagctggagtaagttgtgtttttgtgatgcatttaattgtaagaggtattaaaatagctctgagtttctcaaggatttcgccctggataaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaaccccta

SEQ ID NO: 155900 - DNA, 7603 bp, Homo sapiens
  Payload ID: 10620
  Gene Symbol: MPDZ
  Gene Name: multiple PDZ domain protein
  Uniprot ID: O75970
  ENST ID: ENST00000541718
  CDS Start-End: 223-6348
cgtgagtgtctgtgcgttttgatccgaagctcctcgccgggtcgttacttcagaagagaagacagtgagcgtgggcgaggcgaggcatccagaggccccggcgacccctgctccccagtcctccgccccctcgcgtcgcggccctgggcgggcgccgcgagccggagttccattttaattgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgacttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcac

SEQ ID NO: 155901 - DNA, 427 bp, Homo sapiens
  Payload ID: 10620
  Gene Symbol: MPDZ
  Gene Name: multiple PDZ domain protein
  ENST ID: ENST00000494251
  CDS Start-End: 1-92
agcaagtagcacaagtccttaggcaatgtggaaatagagttaagttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatc

SEQ ID NO: 155902 - DNA, 548 bp, Homo sapiens
  Payload ID: 10620
  Gene Symbol: MPDZ
  Gene Name: multiple PDZ domain protein
  ENST ID: ENST00000542239
  CDS Start-End: 163-548
ttgttaacaccattgtaaaaagatgccgcggcgtatgcttcacattctagattttctgcagcacctgctgacgatcgagcccccttttatgtaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagagaaatcccctttgccttccttgctgcacaacctttaccctaagtacaacttcagcagcactaacccatttgctgactctct

SEQ ID NO: 155903 - DNA, 6176 bp, Homo sapiens
  Payload ID: 10620
  Gene Symbol: MPDZ
  Gene Name: multiple PDZ domain protein
  Uniprot ID: O75970
  ENST ID: ENST00000536827
  CDS Start-End: 44-6070
tgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaagggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaa

SEQ ID NO: 155904 - DNA, 3414 bp, Homo sapiens
  Payload ID: 10620
  Gene Symbol: MPDZ
  Gene Name: multiple PDZ domain protein
  ENST ID: ENST00000545857
  CDS Start-End: 1-3021
gtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaat

SEQ ID NO: 155905 - DNA, 3186 bp, Homo sapiens
  Payload ID: 10620
  Gene Symbol: MPDZ
  Gene Name: multiple PDZ domain protein
  ENST ID: ENST00000538841
  CDS Start-End: 174-2963
gacattgacatttgttaacaccattgtaaaaagatgccgcggcgtatgcttcacattctagattttctgcagcacctgctgacgatcgagcccccttttatgtaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaagggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaagga

SEQ ID NO: 155906 - DNA, 796 bp, Homo sapiens
  Payload ID: 10620
  Gene Symbol: MPDZ
  Gene Name: multiple PDZ domain protein
  ENST ID: ENST00000535169
  CDS Start-End: 1-287
aaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaa

SEQ ID NO: 155907 - DNA, 6342 bp, Homo sapiens
  Payload ID: 10620
  Gene Symbol: MPDZ
  Gene Name: multiple PDZ domain protein
  ENST ID: ENST00000546205
  CDS Start-End: 66-6320
cgagccggagttccattttaattgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaattttctgcagcacctgctgacgatcgagcccccttttatgtaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaacca

SEQ ID NO: 155908 - DNA, 2223 bp, Homo sapiens
  Payload ID: 10621
  Gene Symbol: MVB12A
  Gene Name: multivesicular body subunit 12A
  Uniprot ID: Q96EY5
  ENST ID: ENST00000317040
  CDS Start-End: 1056-1877
agaaaatctccattttgtgtagatgggttgtatgaagacaacccaggaattgaggctcatgaattgagcctgcgtgtctggagtcccaccctgcacatgctagcattcctctcccttcctgtacccaggggaagaaacaataaaacgttatgctttttactgttgagggagaaggggcagttagagtgagagcctctccttctccattcctggccagtgaataaaacctgattgccttttccgattggatgttccttctttgccacctacacaaagtggggaggtaactcggtttgctggtggcatcctcagtagctgggactacaggcaataaattcttttatacgtcgctttttaaacgtattgtgcctgtgaacaaatcttcaagttatacccaagatttcaaagctcatgatggtccatagtactcgctctttaaatcaatagctgcgtatcccacagatgatttcctttgggatgatttcccagaactggaattgcagattcttcacaatgcatttttagtagagaaggggtttcaccacgttggccaggagggtctcgatctcttgacctcatgatccgcccgcctccgcctcccaaagtgccgggattacaggcgtcagccactgcgcgcggccacaaagctcccaacttttccgttaagcaccgagcttttttctagactagcagctgaggccggaaggaattctggggaacgtagtgcagacttgcagagaacgagtctcttggtcctgtgccgtagcatttccggcggaagttgctgggcgcggaaagccggcaagacctttttttccgccatcatcgctcacgcgcgcaaccctggcgacgcgtggtggcgaggctccgcctccccacgccattggccagcagctcctcgggcacgcgtatactgcgcttccgggcaatctccgccccccccccccgcatggccttctgggagttgtagttcggtcgcgagcgctgccgtcgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatagtccctcacccttccgcggaaagagcccccttactccacctccccgccagcctggggccaccccccctcactgcatcctggggccacccccactcactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggctgtgcgggtgtcctcctggcaataaacactacccggttctcgccctctgga

SEQ ID NO: 155909 - DNA, 1091 bp, Homo sapiens
  Payload ID: 10621
  Gene Symbol: MVB12A
  Gene Name: multivesicular body subunit 12A
  ENST ID: ENST00000529939
  CDS Start-End: 65-886
cgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggcaggtctgcccagctcccggaacactctgaaagccgcacgccaaacccatatcaggtgcctggagtctggaggttttggctgcagccccaggaccagccttgccctgcgcctcacctgattctggctgagataggaagatgctcggtaactcagctccccttccaggcagtgcagacgagggggcggttttcagccgggcctcccaagttggaaccttatcatttccaaggttcaagtttgaggtatcaggaggaagagcagggaccagcctagggtgaggttgctgaggtgcccagggtgcaattttttatttatttttattt

SEQ ID NO: 155910 - DNA, 820 bp, Homo sapiens
  Payload ID: 10621
  Gene Symbol: MVB12A
  Gene Name: multivesicular body subunit 12A
  ENST ID: ENST00000528911
  CDS Start-End: 457-820
tacaggcagaggattaattaggttttcagtttcagtttcccagaaaggaggtgtctctgtggtgacgagcagggcttcatccagtgcctctgtccccaccgaggggactatgggagacatggagggtgtgtgagcaacaggtgagactggagccagctgaaaactgggagaccgacccagccaacaaacaatgtcggtctctgtcttggcacctgcaggaaacaagctcctacttccagaaaaagtgctcctgggactccaggataccagatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcag

SEQ ID NO: 155911 - DNA, 686 bp, Homo sapiens
  Payload ID: 10621
  Gene Symbol: MVB12A
  Gene Name: multivesicular body subunit 12A
  ENST ID: ENST00000528515
  CDS Start-End: 55-654
tccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggag

SEQ ID NO: 155912 - DNA, 656 bp, Homo sapiens
  Payload ID: 10621
  Gene Symbol: MVB12A
  Gene Name: multivesicular body subunit 12A
  ENST ID: ENST00000528604
  CDS Start-End: 256-656
aggttttcagtttcagtttcccagaaaggaggtgtctctgtggtgacgagcagggcttcatccagtgcctctgtccccaccgaggggactatgggagacatggagggtgtgtgagcaacaggtgagactggagccagctgaaaactgggagaccgacccagccaacaaacaatgtcggtctctgtcttggcacctgcaggaaacaagctcctacttccagaaaaagtgctcctgggactccaggataccagggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctc

SEQ ID NO: 155913 - DNA, 1154 bp, Homo sapiens
  Payload ID: 10621
  Gene Symbol: MVB12A
  Gene Name: multivesicular body subunit 12A
  Uniprot ID: Q96EY5
  ENST ID: ENST00000543795
  CDS Start-End: 26-847
ccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatagtccctcacccttccgcggaaagggccaccccccctcactgcatcctggggccacccccactcactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggctgtgcgggtgtcctcctggcaataaacactacccggttctcgcc

SEQ ID NO: 155914 - DNA, 705 bp, Homo sapiens
  Payload ID: 10621
  Gene Symbol: MVB12A
  Gene Name: multivesicular body subunit 12A
  ENST ID: ENST00000594784
  CDS Start-End: 1-367
ataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctgtataactacggcttcgtggtggagaagaccgcggctgcccgcctgccccccagcgtctcatagtccctcacccttccgcggaaagagcccccttactccacctccccgccagcctggggccaccccccctcactgcatcctggggccacccccactcactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggctgtgcgggtgtcctcctggcaataaacactacccggttctcgc

SEQ ID NO: 155915 - DNA, 795 bp, Homo sapiens
  Payload ID: 10621
  Gene Symbol: MVB12A
  Gene Name: multivesicular body subunit 12A
  ENST ID: ENST00000600514
  CDS Start-End: 432-795
atggagggtgtgtgagcaacaggtgagactggagccagctgaaaactgggagaccgacccagccaacaaacaatgtcggtctctgtcttggcacctgcaggaaacaagctcctacttccagaaaaagtgctcctgggactccaggataccaggcatctggacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcag

SEQ ID NO: 155916 - DNA, 4819 bp, Homo sapiens
  Payload ID: 10622
  Gene Symbol: MVB12B
  Gene Name: multivesicular body subunit 12B
  Uniprot ID: Q9H7P6
  ENST ID: ENST00000361171
  CDS Start-End: 82-1041
cggtgaggctcgcgctcgagctgcggcgccggctcctgccgcctgggccccgggcccggcccctcccgcgccgcccgggcgatgagaagctgcttctgcgtgagacggagccgggacccgccgccgccgcagccaccgccgccgccgccccagcggggaacagaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagcaatggatggtgtgccttttatgatttcagagaagttttcttgtgttccagaaagtatgcagccctttgatctcctgggaatcaccatcaaatctctagcagaaatcgaaaaagagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctcactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccctgtggcacccacagggggcacctatgtctgccgtggctcctcgggtggtgccctgtgtgacaaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtgtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcacatttctcctttcattccccctaaaaacagagtgacctggaagtagatgttctttgctccttgtcagagttgaagaggctgacttggcccactgctaagcggcagaggcagggccagccatcctgtcgcaagcccgtgctggggctgccctttctgtttccagtccagttacggacttcccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctctttc

SEQ ID NO: 155917 - DNA, 770 bp, Homo sapiens
  Payload ID: 10622
  Gene Symbol: MVB12B
  Gene Name: multivesicular body subunit 12B
  ENST ID: ENST00000402437
  CDS Start-End: 154-770
gtgatttgactctggctggtcaccaggtaatctgtccaaagttcagaaggtgtcaggatgctatcctgaggctccacagtgacagcctctcagtctgtgcactgtcccccacgggtggccccaaagccagctgcccatttaactgggcacagcatggacactggcctcagctctcagccttctgaggaggaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccag

SEQ ID NO: 155918 - DNA, 2666 bp, Homo sapiens
  Payload ID: 10622
  Gene Symbol: MVB12B
  Gene Name: multivesicular body subunit 12B
  Uniprot ID: Q9H7P6
  ENST ID: ENST00000489637
  CDS Start-End: 69-734
gctcgagctgcggcgccggctcctgccgcctgggccccgggcccggcccctcccgcgccgcccgggcgatgagaagctgcttctgcgtgagacggagccgggacccgccgccgccgcagccaccgccgccgccgccccagcggggaacagaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggtgaggccttgtcggggtgtcttgcgttgtcctgtggtcttaggtccctgcacaacattttagaacaccaccacttagtgtctgctgaaatactgcaaagtacagctgaataattgtagaagcaatatatctttagaggagatttttaaaaatccacttggaaatctttgcattacatgaatgcaaaggccattctatagtctattttgtgcgtgttctgcaggcttctaaaattgcagattatgcaacttaaaattggctccctattcaaaagagctgctagctacacacagacacgtgctgtatagccatggggttgggatcactggccttaaggtcaaattccttctctgtcttggccagcaactcatttgaaacccaggagggtaggtgagttcttatattcttcattttcatataatttctttttccaatgagctataaagtaagaaatgggtagtttgggtatgagagaatagtgaggagtttttcaggaaatgctagttttaacaattgtctccgcaaagaaacttgggtgagccaactgtttgctctgcaactgatttcagtcataacagaggtagtaacagtctctacactttctgcaaaaagaatcctgtcaaataaaaatcctgtgcatcactaggagtaaactaagggcaaggaacaaacagcactgatggattaagcttgagaaagggattgcaaaagtaaataaaacaagaacggtgaggcagcaacacttagggattgacataacgtaaatgagaatggatctccaagcttccacgtgggtgaatagagatgaacaaaatctgtcaggaaccggacagaagagtcaccagtaggtcttcctgggccatccacaatacagcctgccctccgggacataccaccagctctctgtactctgttcctctgtgccaagcctccgtctcacttggaagaatgtgctgtaatgaggctccaaagccctgaggactctgtcctctgggacatccccctataaagacaatctggtccttctcatgacagtttcacaaaccaagagtggtatttaaacttaactacccctggaattgcctgaaactttagaagtagttttcagtttcatttggcataaaaagataggaatctctaataagcctcccagagttgcagggtgaacagttgagtctctgttgggttcaagagtgtgaggttcgcactgcccatcagcacttgttcctcacttctgagccagagcgctgtcagctccgccctggagggcactgctgagggtcactgtctcctgtgctcaaggctatatcaggtgtgtcacctgtgctggggagtcagctaagtccatcacctgtgtgtcggggtcctccatcacctgtgctgaggcccatcacttgtacttggagcagctcaagtgtgggctccttgcagaggctggaaagcccccacaggagcagttgccctgaagttgttacagctgctccctgctgacatcatgtggtctagaagggcccagaaatgggcaccacctcaggcaggttttgactttctgtggttaaagaaagaacaccagttctctcagataaagcagagagagctctcagaagcctgctggtgactgtgagagcaaagtcacttgcacctgaagcaagacagccgagaacaccgagccaccggcagcctggtgggtttggagggtagtgcgtcagaaccagatgtttataaggcttatgtattttatcacctctgctgtacagtttatggtttacaatggctgcaaggaaatcggatcagttttgttttacttgccaaataaaacaaatgtcaaaatagtcaatataaaatgtattctaatttggctgagttaagtcagccaatatgcaacaggataattgaatgttcattagtgcttccaagtaaaagccatttgtctgtc

SEQ ID NO: 155919 - DNA, 5815 bp, Homo sapiens
  Payload ID: 10623
  Gene Symbol: MRVI1
  Gene Name: murine retrovirus integration site 1 homolog
  Uniprot ID: Q9Y6F6
  ENST ID: ENST00000424001
  CDS Start-End: 781-2574
cagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagcagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctc

SEQ ID NO: 155920 - DNA, 6126 bp, Homo sapiens
  Payload ID: 10623
  Gene Symbol: MRVI1
  Gene Name: murine retrovirus integration site 1 homolog
  Uniprot ID: Q9Y6F6
  ENST ID: ENST00000423302
  CDS Start-End: 151-2889
attatcccccgagccaggccggagtggggctcccagaggagctctcggctctaagtcccagcccctctcagaggaggcgtgcggccgaggttctgcagccagaggcttctcggctctgagctccggagccagatgtaacattgaccttaaatggtaaaagctccccagagtgaagagaggctggccagaggaggaaaggagaataactcagttttagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaa

SEQ ID NO: 155921 - DNA, 558 bp, Homo sapiens
  Payload ID: 10623
  Gene Symbol: MRVI1
  Gene Name: murine retrovirus integration site 1 homolog
  ENST ID: ENST00000533631
  CDS Start-End: 1-354
aaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccagcagaagggggatgaggccgacgtctcttcacctcaccctggcgagcctgagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcg

SEQ ID NO: 155922 - DNA, 2686 bp, Homo sapiens
  Payload ID: 10623
  Gene Symbol: MRVI1
  Gene Name: murine retrovirus integration site 1 homolog
  ENST ID: ENST00000527509
  CDS Start-End: 195-2660
gaggctggccagaggaggaaaggagaataactcagttttagacagggtctcgcactgtcacccaggctggagtgcagtggtgcaaccccacctcccgggttcaagcaattctcatgcctcagcctcccaagtagctgggattacagggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccct

SEQ ID NO: 155923 - DNA, 540 bp, Homo sapiens
  Payload ID: 10623
  Gene Symbol: MRVI1
  Gene Name: murine retrovirus integration site 1 homolog
  ENST ID: ENST00000531308
  CDS Start-End: 21-227
agatgtaacattgaccttaaatggtaaaagctccccagagtgaagagaggctggccagaggaggaaaggagaataactcagttttagacagggtctcgcactgtcacccaggctggagtgcagtggtgcaaccccacctcccgggttcaagcaattctcatgcctcagcctcccaagtagctgggattacagagattccatcaagaagacttctgcactgggtttgaggctctgaccatccacagtcctgggtcctattctcaactccaaaaacaccgcaaggagagtggtggacttcctctcaagaggattgggcatctgtgtctggtgaagtctttaaggaggcccaataaataacacctctttccttcactgaagctttaaggcttgttgggaattcagagactaatatcacccgtatgactgatgaagctggtgttggaaagtgtttggatcaacagcctgtggagcccaggcctcttggagcatctttggggctgacgcagcggaggttccgggcacacgtggccactcccagca

SEQ ID NO: 155924 - DNA, 545 bp, Homo sapiens
  Payload ID: 10623
  Gene Symbol: MRVI1
  Gene Name: murine retrovirus integration site 1 homolog
  ENST ID: ENST00000529547
  CDS Start-End: 339-545
gaataacctgcctcttcggctgggaagcggagggaaccttctcttccttaaaggagacaaatctgggagctctgagccactaggatgaacaccagagtctctctgagccttggcttggttttgttgatgctgtgcatgcttagagaactcagctgccctgtttggagaatggcgagggcactgagtggactctatgtaccagcaccttgcatgtatttcctgatttaatcgttacaacaacgctaaaagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccga

SEQ ID NO: 155925 - DNA, 2887 bp, Homo sapiens
  Payload ID: 10623
  Gene Symbol: MRVI1
  Gene Name: murine retrovirus integration site 1 homolog
  Uniprot ID: Q9Y6F6
  ENST ID: ENST00000531107
  CDS Start-End: 65-2779
aaactcaagccggctctcactgtggcttgtggctccgggaaatggaacccagcttgggacagggatgggaatggatttgacttgtccttttggcatctccccagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagcagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatca

SEQ ID NO: 155926 - DNA, 2824 bp, Homo sapiens
  Payload ID: 10623
  Gene Symbol: MRVI1
  Gene Name: murine retrovirus integration site 1 homolog
  Uniprot ID: Q9Y6F6
  ENST ID: ENST00000534266
  CDS Start-End: 1023-2816
cctctgactttgtaaacaaagccagagagccggaggaaatgaaattccaaatgccctctcctagcctggtttgacctccggtgttgatgcaaactcaagccggctctcactgtggcttgtggctccgggaaatggaacccagcttgggacagggatgggaatggatttgacttgtccttttggcatctccccagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaacagggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctc

SEQ ID NO: 155927 - DNA, 529 bp, Homo sapiens
  Payload ID: 10623
  Gene Symbol: MRVI1
  Gene Name: murine retrovirus integration site 1 homolog
  ENST ID: ENST00000529068
  CDS Start-End: 1-191
agagtgaagagaggctggccagaggaggaaaggagaataactcagttttagacagggtctcgcactgtcacccaggctggagtgcagtggtgcaaccccacctcccgggttcaagcaattctcatgcctcagcctcccaagtagctgggattacagagattccatcaagaagacttctgcactgggtttgaggctctgaccatccacagtcctgggtcctattctcaactccaaaaacaccgcaaggagagtggtggacttcctctcaagaggattgggcatctgtgtctggtgaagtctttaaggaggcccaataaataacacctctttccttcactgaagctttaaggcttgttgggaattcagagactaatatcacccgtatgactgatgaagctggtgttggaaagtgtttggatcaacagggtcctcctgccgcaggagtatcttgcagtccaactcccacgattgtcctgactggggatgccacttcaccagaaggagaaaccgacaaaaacctggccaacag

SEQ ID NO: 155928 - DNA, 2548 bp, Homo sapiens
  Payload ID: 10623
  Gene Symbol: MRVI1
  Gene Name: murine retrovirus integration site 1 homolog
  ENST ID: ENST00000529448
  CDS Start-End: 13-276
cattgaccttaaatggtaaaagctccccagagtgaagagaggctggccagaggaggaaaggagaataactcagttttagggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctc

SEQ ID NO: 155929 - DNA, 1650 bp, Homo sapiens
  Payload ID: 10623
  Gene Symbol: MRVI1
  Gene Name: murine retrovirus integration site 1 homolog
  ENST ID: ENST00000526414
  CDS Start-End: 151-1437
atatcctagaataacctgcctcttcggctgggaagcggagggaaccttctcttccttaaagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaacagggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctgagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcagga

SEQ ID NO: 155930 - DNA, 2468 bp, Homo sapiens
  Payload ID: 10623
  Gene Symbol: MRVI1
  Gene Name: murine retrovirus integration site 1 homolog
  Uniprot ID: Q9Y6F6
  ENST ID: ENST00000541483
  CDS Start-End: 21-2141
agatgtaacattgaccttaaatggtaaaagctccccagagtgaagagaggctggccagaggaggaaaggagaataactcagttttagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctgagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggt

SEQ ID NO: 155931 - DNA, 6155 bp, Homo sapiens
  Payload ID: 10623
  Gene Symbol: MRVI1
  Gene Name: murine retrovirus integration site 1 homolog
  Uniprot ID: Q9Y6F6
  ENST ID: ENST00000547195
  CDS Start-End: 1121-2914
ggcgctggcccagggtcttctccaggctcacatgcttgctggaggctccaggcgggtggggagatctgcagggtccctttgttcccgtccggccaggacagtgtccagtggcacgagttgccatggggactgccatctgctgtgtggatacccatcggaggggcccagggtgagcgactgccccaaaggcccagcctgccctgagccctgaggccagctggtcggctttccctgccattatcccccgagccaggccggagtggggctcccagaggagctctcggctctaagtcccagcccctctcagaggaggcgtgcggccgaggttctgcagccagaggcttctcggctctgagctccggagccagatgtaacattgaccttaaatggtaaaagctccccagagtgaagagaggctggccagaggaggaaaggagaataactcagttttagggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctc

SEQ ID NO: 155932 - DNA, 3339 bp, Homo sapiens
  Payload ID: 10623
  Gene Symbol: MRVI1
  Gene Name: murine retrovirus integration site 1 homolog
  Uniprot ID: Q9Y6F6
  ENST ID: ENST00000558540
  CDS Start-End: 974-2767
gaataactcagttttaggtaagcctcccctatatcctagaataacctgcctcttcggctgggaagcggagggaaccttctcttccttaaagacagggtctcgcactgtcacccaggctggagtgcagtggtgcaaccccacctcccgggttcaagcaattctcatgcctcagcctcccaagtagctgggattacagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagcagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcag

SEQ ID NO: 155933 - DNA, 2392 bp, Homo sapiens
  Payload ID: 10624
  Gene Symbol: MUS81
  Gene Name: MUS81 structure-specific endonuclease subunit
  Uniprot ID: Q96NY9
  ENST ID: ENST00000308110
  CDS Start-End: 350-2005
acaaagaccccgctctcgaatctggggtgacaggaaggagccggtccaggctccgggggctgggaaagggcgcgtctcaaaggctggctggagtggagccaagggaaaagatcgttagagacagcgcccctgaccaaccacttagagcagcgcaggggtgggagggcggccgcaggctctcctctcgttagtgccccctgtgtttggggccccgtgatctcaacggtcctgccctcggtctccctcttcccccgccccgccctgggccaggtgttcgaatcccgactccagaactggcggcgtcccagtcccgcgggcgtggagcgccggaggacccgccctcgggctcatggcggccccggtccgcctgggccggaagcgcccgctgcctgcctgtcccaacccgctcttcgttcgctggctgaccgagtggcgggacgaggcgacccgcagcaggcgccgcacgcgcttcgtatttcagaaggcgctgcgttccctccgacggtacccactgccgctgcgcagcgggaaggaagctaagatcctacagcacttcggagacgggctctgccggatgctggacgagcggctgcagcggcaccgaacatcgggcggtgaccatgccccggactcaccatctggagagaacagtccagccccgcaggggcgacttgcggaagtccaggactcttccatgccagttcctgcccagcccaaagcgggaggctctggcagctactggccagctcggcactcaggagcccgagtgatactgctggtgctctaccgggagcacctgaatcctaatggtcaccacttcttaaccaaggaggagctgctgcagaggtgtgctcagaagtcccccagggtagcccctgggagtgctcgaccctggccagccctccgctccctccttcacaggaacctggtcctcaggacacaccagccagccaggtactcattgaccccagagggcctggagctggcccagaagttggccgagtcagaaggcctgagcttgctgaatgtgggcatcgggcccaaggagccccctggggaggagacagcagtgccaggagcagcttcagcagagcttgccagtgaagcaggggtccagcagcagccactggagctgaggcctggagagtacagggtgctgttgtgtgtggacattggcgagacccgggggggcgggcacaggccggagctgctccgagagctacagcggctgcacgtgacccacacggtgcgcaagctgcacgttggagattttgtgtgggtggcccaggagaccaatcctagagacccagcaaaccctggggagttggtactggatcacattgtggagcgcaagcgactggatgacctttgcagcagcatcatcgacggccgcttccgggagcagaagttccggctgaagcgctgtggtctggagcgccgggtatacctggtggaagagcatggttccgtccacaacctcagccttcctgagagcacactgctgcaggctgtcaccaacactcaggtcattgatggcttttttgtgaagcgcacagcagacattaaggagtcagccgcctacctggccctcttgacgcggggcctgcagagactctaccagggccacaccctacgcagccgcccctggggaacccctgggaaccctgaatcaggggccatgacctctccaaaccctctctgctcactcctcaccttcagtgacttcaacgcaggagccatcaagaataaggcccagtcggtgcgagaagtgtttgcccggcagctgatgcaggtgcgcggagtgagtggggagaaggcagcagccctggtggatcgatacagcacccctgccagcctcctggccgcctatgatgcctgtgccacccccaaggaacaagagacactgctgagcaccattaagtgtgggcgtctacagaggaatctggggcctgctctgagcaggaccttatcccagctctactgcagctacggccccttgacctgagcttatgccgtgaaacagcccccagcccccgtctgtcccccaacccaggctagccagccttttaacaacatcttttggggtacaattagaatctaagtgtttgcagccatatgtgtcatgtagaagatgcctagccctggggaccttgtgaaatacgcaggaaccagggataccatctggtccagtggtttttaaacaaagctgcttagcacctggaattccctggtcagggagatggagtcagtggggcattgcagcttggaatctattttatgtcaccagttggtcctcatcaaataaaatttccttaggagtgcagagggctcattgggaaaataaaaataataaaaataaataaaacttcctaaaagaaaagattgaaaacca

SEQ ID NO: 155934 - DNA, 923 bp, Homo sapiens
  Payload ID: 10624
  Gene Symbol: MUS81
  Gene Name: MUS81 structure-specific endonuclease subunit
  ENST ID: ENST00000525768
  CDS Start-End: 519-923
cttagagcagcgcaggggtgggagggcggccgcaggctctcctctcgttagtgccccctgtgtttggggccccgtgatctcaacggtcctgccctcggtctccctcttcccccgccccgccctgggccaggtgttcgaatcccgactccagaactggcggcgtcccagtcccgcgggcgtggagcgccggaggacccgccctcgggctcatggcggccccggtccgcctgggccggaagcgcccgctgcctgcctgtcccaacccgctcttcgttcgctggctgaccgagtggcgggacgaggcgacccgcagcaggcgccgcacgcgcttcgtatttcagaaggtgggtcctggcgtggcccgatgggaaaagctgctggccaggtcaggcctgccctgaccaggtaccctacccctgcccggccaggcgctgcgttccctccgacggtacccactgccgctgcgcagcgggaaggaagctaagatcctacagcacttcggagacgggctctgccggatgctggacgagcggctgcagcggcaccgaacatcgggcggtgaccatgccccggactcaccatctggagagaacagtccagccccgcaggggcgacttgcggaagtccaggactcttccatgccagttcctgcccagcccaaagcgggaggctctggcagctactggccagctcggcactcaggagcccgagtgatactgctggtgctctaccgggagcacctgaatcctaatggtcaccacttcttaaccaaggaggagctgctgcagaggtgtgctcagaagtcccccagggtagcccctgggagtgctcgaccctggccagccctccgctccctccttcacaggaacctggtcctcaggacacaccagccagccaggtactcattgaccccagagggcctg

SEQ ID NO: 155935 - DNA, 906 bp, Homo sapiens
  Payload ID: 10624
  Gene Symbol: MUS81
  Gene Name: MUS81 structure-specific endonuclease subunit
  ENST ID: ENST00000529857
  CDS Start-End: 299-906
atctccaggtccctaaccctgtggaatcgccctaaaacaacgggtgtatcagacccatctcctgcaggcaggagcctgggcaagctacataaccttcggttttctcagccctcgggccgtatacagggggcggggtggtttccgggcggtgcccgcctgggtcacttccctaaactcggctccaccctcactcaggcccatccgggaaggcctcgctggcccagggcttcggcaccggcggccgggcctgagcgtgcgcgcacgcgccgacagacagcgccgttccagccctcgcccgatgcacggcccccgcctctcctggactcttttcaagaccagtctccatctccagcctccttcaagcttgaggctgaagctgacaatcttaagagaccttagagccgccaagctcaggtgttcgaatcccgactccagaactggcggcgtcccagtcccgcgggcgtggagcgccggaggacccgccctcgggctcatggcggccccggtccgcctgggccggaagcgcccgctgcctgcctgtcccaacccgctcttcgttcgctggctgaccgagtggcgggacgaggcgacccgcagcaggcgccgcacgcgcttcgtatttcagaaggcgctgcgttccctccgacggtacccactgccgctgcgcagcgggaaggaagctaagatcctacagcacttcggagacgggctctgccggatgctggacgagcggctgcagcggcaccgaacatcgggcggtgaccatgccccggactcaccatctggagagaacagtccagccccgcaggggcgacttgcggaagtccaggactcttccatgccagttcctgcccagcccaaagcgggaggctctggcagctactggccagctcggcactcaggagc

SEQ ID NO: 155936 - DNA, 2180 bp, Homo sapiens
  Payload ID: 10624
  Gene Symbol: MUS81
  Gene Name: MUS81 structure-specific endonuclease subunit
  ENST ID: ENST00000533035
  CDS Start-End: 362-1792
ttcctctccaccacacactctttgccctgtatcccggggatgaggatcaccatttcctccaagggtcctgcagctcctcctgccttacctttgtgtcctcatccccggcacccatttctgggtgtccctcccaccaatacgtttgcacccgtttgtctcctagcccccgcctctcctggactcttttcaagaccagtctccatctccagcctccttcaagcttgaggctgaagctgacaatcttaagagaccttagagccgccaagctcaggcgctgcgttccctccgacggtacccactgccgctgcgcagcgggaaggaagctaagatcctacagcacttcggagacgggctctgccggatgctggacgagcggctgcagcggcaccgaacatcgggcggtgaccatgccccggactcaccatctggagagaacagtccagccccgcaggggcgacttgcggaagtccaggactcttccatgccagttcctgcccagcccaaagcgggaggctctggcagctactggccagctcggcactcaggagcccgagtgatactgctggtgctctaccgggagcacctgaatcctaatggtcaccacttcttaaccaaggaggagctgctgcagaggtgtgctcagaagtcccccagggtagcccctgggagtgctcgaccctggccagccctccgctccctccttcacaggaacctggtcctcaggacacaccagccagccaggtactcattgaccccagagggcctggagctggcccagaagttggccgagtcagaaggcctgagcttgctgaatgtgggcatcgggcccaaggagccccctggggaggagacagcagtgccaggagcagcttcagcagagcttgccagtgaagcaggggtccagcagcagccactggagctgaggcctggagagtacagggtgctgttgtgtgtggacattggcgagacccgggggggcgggcacaggccggagctgctccgagagctacagcggctgcacgtgacccacacggtgcgcaagctgcacgttggagattttgtgtgggtggcccaggagaccaatcctagagacccagcaaaccctggggagttggtactggatcacattgtggagcgcaagcgactggatgacctttgcagcagcatcatcgacggccgcttccgggagcagaagttccggctgaagcgctgtggtctggagcgccgggtatacctggtggaagagcatggttccgtccacaacctcagccttcctgagagcacactgctgcaggctgtcaccaacactcaggtcattgatggcttttttgtgaagcgcacagcagacattaaggagtcagccgcctacctggccctcttgacgcggggcctgcagagactctaccagggccacaccctacgcagccgcccctggggaacccctgggaaccctgaatcaggggccatgacctctccaaaccctctctgctcactcctcaccttcagtgacttcaacgcaggagccatcaagaataaggcccagtcggtgcgagaagtgtttgcccggcagctgatgcaggtgcgcggagtgagtggggagaaggcagcagccctggtggatcgatacagcacccctgccagcctcctggccgcctatgatgcctgtgccacccccaaggaacaagagacactgctgagcaccattaagtgtgggcgtctacagaggaatctggggcctgctctgagcaggaccttatcccagctctactgcagctacggccccttgacctgagcttatgccgtgaaacagcccccagcccccgtctgtcccccaacccaggctagccagccttttaacaacatcttttggggtacaattagaatctaagtgtttgcagccatatgtgtcatgtagaagatgcctagccctggggaccttgtgaaatacgcaggaaccagggataccatctggtccagtggtttttaaacaaagctgcttagcacctggaattccctggtcagggagatggagtcagtggggcattgcagcttggaatctattttatgtcaccagttggtcctcatcaaataaaatttccttaggagtgcagagggctcattgggaaaataaaaataataaaaataaataaaacttcctaaaagaaaagattgaaaaccac

SEQ ID NO: 155937 - DNA, 1817 bp, Homo sapiens
  Payload ID: 10624
  Gene Symbol: MUS81
  Gene Name: MUS81 structure-specific endonuclease subunit
  ENST ID: ENST00000524647
  CDS Start-End: 1-1169
ggcgccgcacgcgcttcgtatttcagaaggcgctgcgttccctccgacggtacccactgccgctgcgcagcgggaaggaagctaagatcctacagcacttcggagacgggctctgccggatgctggacgagcggctgcagcggcaccgaacatcgggcggtgaccatgccccggactcaccatctggagagaacagtccagccccgcaggggcgacttgcggaagtccaggactcttccatgccagttcctgcccagcccaaagcgggaggctctggcagctactggccagctcggcactcaggagcccgagtgatactgctggtgctctaccgggagcacctgaatcctaatggtcaccacttcttaaccaaggaggagctgctgcagaggtgtgctcagaagtcccccagggtagcccctgggagtgctcgaccctggccagccctccgctccctccttcacaggaacctggtcctcaggacacaccagccagccaggtactcattgaccccagagggcctggagctggcccagaagttggccgagtcagaaggcctgagcttgctgaatgtgggcatcgggcccaaggagccccctggggaggagacagcagtgccaggagcagcttcagcagagcttgccagtgaagcaggggtccagcagcagccactggagctgaggcctggagagtacagggtgctgttgtgtgtggacattggcgagacccgggggggcgggcacaggccggagctgctccgagagctacagcggctgcacgtgacccacacggtgcgcaagctgcacgttggagattttgtgtgggtggcccaggagaccaatcctagagacccagcaaaccctggggagttggtactggatcacattgtggagcgcaagcgactggatgacctttgcagcagcatcatcgacggccgcttccgggagcagaagttccggctgaagcgctgtggtctggagcgccgggtatacctggtggaagagcatggttccgtccacaacctcagccttcctgagagcacactgctgcaggctgtcaccaacactcaggtcattgatggcttttttgtgaagcgcacagcagacattaaggagtcagccgcctacctggccctcttgacgcggggcctgcagagactctaccagtgacttcaacgcaggagccatcaagaataaggcccagtcggtgcgagaagtgtttgcccggcagctgatgcaggtgcgcggagtgagtggggagaaggcagcagccctggtggatcgatacagcacccctgccagcctcctggccgcctatgatgcctgtgccacccccaaggaacaagagacactgctgagcaccattaagtgtgggcgtctacagaggaatctggggcctgctctgagcaggaccttatcccagctctactgcagctacggccccttgacctgagcttatgccgtgaaacagcccccagcccccgtctgtcccccaacccaggctagccagccttttaacaacatcttttggggtacaattagaatctaagtgtttgcagccatatgtgtcatgtagaagatgcctagccctggggaccttgtgaaatacgcaggaaccagggataccatctggtccagtggtttttaaacaaagctgcttagcacctggaattccctggtcagggagatggagtcagtggggcattgcagcttggaatctattttatgtcaccagttggtcctcatcaaataaaatttccttaggagtgcagagggctcattgggaaaataaaaataataaaaataaataaaacttcc

SEQ ID NO: 155938 - DNA, 692 bp, Homo sapiens
  Payload ID: 10624
  Gene Symbol: MUS81
  Gene Name: MUS81 structure-specific endonuclease subunit
  ENST ID: ENST00000530111
  CDS Start-End: 1-692
ggggcgacttgcggaagtccaggactcttccatgccagttcctgcccagcccaaagcgggaggctctggcagctactggccagctcggcactcaggagcccgagtgatactgctggtgctctaccgggagcacctgaatcctaatggtcaccacttcttaaccaaggaggagctgctgcagaggtgtgctcagaagtcccccagggtagcccctgggagtgctcgaccctggccagccctccgctccctccttcacaggaacctggtcctcaggacacaccagccagccaggtactcattgaccccagagggcctggagctggcccagaagttggccgagtcagaaggcctgagcttgctgaatgtgggcatcgggcccaaggagccccctggggaggagacagcagtgccaggagcagcttcagcagagcttgccagtgaagcaggggtccagcagcagccactggagctgaggcctggagagtacagggtgctgttgtgtgtggacattggcgagacccgggggcttccctccttgccactccaggggcgggcacaggccggagctgctccgagagctacagcggctgcacgtgacccacacgcaaaccctggggagttggtactggatcacattgtggagcgcaagcgactggatgacctttgcagcagcatcatcgacggccgcttcc

SEQ ID NO: 155939 - DNA, 1232 bp, Homo sapiens
  Payload ID: 10624
  Gene Symbol: MUS81
  Gene Name: MUS81 structure-specific endonuclease subunit
  ENST ID: ENST00000529374
  CDS Start-End: 1-1232
gctggacgagcggctgcagcggcaccgaacatcgggcggtgaccatgccccggactcaccatctggagagaacagtccagccccgcaggggcgacttgcggaagtccaggactcttccatgccagttcctgcccagcccaaagcgggaggctctggcagctactggccagctcggcactcaggagcccgagtgatactgctggtgctctaccgggagcacctgaatcctaatggtcaccacttcttaaccaaggaggagctgctgcagaggtgtgctcagaagtcccccagggtagcccctgggagtgctcgaccctggccagccctccgctccctccttcacaggaacctggtcctcaggacacaccagccagccaggtactcattgaccccagagggcctggagctggcccagaagttggccgagtcagaaggcctgagcttgctgaatgtgggcatcgggcccaaggagccccctggggaggagacagcagtgccaggagcagcttcagcagagcttgccagtgaagcaggggtccagcagcagccactggagctgaggcctggagagtacagggtgctgttgtgtgtggacattggcgagacccgggggggcgggcacaggccggagctgctccgagagctacagcggctgcacgtgacccacacggtgcgcaagctgcacgttggagattttgtgtgggtggcccaggagaccaatcctagagacccagcagcaaaccctggggagttggtactggatcacattgtggagcgcaagcgactggatgacctttgcagcagcatcatcgacggccgcttccgggagcagaagttccggctgaagcgctgtggtctggagcgccgggtatacctggtggaagagcatggttccgtccacaacctcagccttcctgagagcacactgctgcaggctgtcaccaacactcaggtcattgatggcttttttgtgaagcgcacagcagacattaaggagtcagccgcctacctggccctcttgacgcggggcctgcagagactctaccagggccacaccctacgcagccgcccctggggaacccctgggaaccctgaatcaggggccatgacctctccaaaccctctctgctcactcctcaccttcagtgacttcaacgcaggagccatcaagaataaggcccagtcggtgcgagaagtgtttgcccggcagctgatgcaggtgcgcggagtga

SEQ ID NO: 155940 - DNA, 733 bp, Homo sapiens
  Payload ID: 10624
  Gene Symbol: MUS81
  Gene Name: MUS81 structure-specific endonuclease subunit
  ENST ID: ENST00000529742
  CDS Start-End: 1-192
gcccagtcggtgcgagaagtgtttgcccggcagctgatgcaggtgcgcggagtgagtggggagaaggcagcagccctggtggatcgatacagcacccctgccagcctcctggccgcctatgatgcctgtgccacccccaaggaacaagagacactgctgagcaccattaagtgtgggcgtctacagaggtgagggcaagagacggaacctggagggagtggcagggactggggctgccctaggcccagggcgtgaccctcgctgcctctcttcctgcaggaatctggggcctgctctgagcaggaccttatcccagctctactgcagctacggccccttgacctgagcttatgccgtgaaacagcccccagcccccgtctgtcccccaacccaggctagccagccttttaacaacatcttttggggtacaattagaatctaagtgtttgcagccatatgtgtcatgtagaagatgcctagccctggggaccttgtgaaatacgcaggaaccagggataccatctggtccagtggtttttaaacaaagctgcttagcacctggaattccctggtcagggagatggagtcagtggggcattgcagcttggaatctattttatgtcaccagttggtcctcatcaaataaaatttccttaggagtgcagagggctcattgggaaaataaaaataataaaaataaataaaacttcctaaaagaaaagattgaaaacca

SEQ ID NO: 155941 - DNA, 2975 bp, Homo sapiens
  Payload ID: 10625
  Gene Symbol: MSI1
  Gene Name: musashi RNA-binding protein 1
  Uniprot ID: O43347
  ENST ID: ENST00000257552
  CDS Start-End: 90-1178
cttcgccgcgctcctcatctgccccgcgccgagcgccgccgccgccgccgccgccgccgctccgctgcccgcgccgcccgcggctcccgatggagactgacgcgccccagcccggcctcgcctccccggactcgccgcacgacccctgcaagatgttcatcgggggactcagttggcagactacgcaggaagggctgcgcgaatacttcggccagttcggggaggtgaaggagtgtctggtgatgcgggaccccctgaccaagagatccaggggtttcggcttcgtcactttcatggaccaggcgggggtggataaagtgctggcgcaatcgcggcacgagctcgactccaaaacaattgaccctaaggtggccttccctcggcgagcacagcccaagatggtgactcgaacgaagaagatctttgtgggggggctgtcggtgaacaccacggtggaggacgtgaagcaatattttgagcagtttgggaaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgcccctggctacacctaccagttccccgaattccgtgtagagcggacccctctcccgagcgccccagtcctccccgagcttacagccattcctctcactgcctacggaccaatggcggcggcagcggcggcagcggctgtggttcgagggacaggctctcacccctggacgatggctccccctccaggttcgactcccagccgcacagggggcttcctggggaccaccagccccggccccatggccgagctctacggggcggccaaccaggactcgggggtcagcagttacatcagcgccgccagccctgcccccagcaccggcttcggccacagtcttgggggccctttgattgccacagccttcaccaatgggtaccactgaagcaggggacggtggcaggagcgccccagcctgcagctgactgaggaccacgagtgagccagcgagggggcgggagacctcagccgcagccgccgccccctcccctgcagcgactcggacccgctactgcctgcccccaactccccgggcccggcccctgccctgctgcccccaacagcgtctggctcccctactaacgtccccctcttcgcccttgcccccatccccacccgcccctctcccggccctgcttttatttattttggattagccggttgcccaccccagccctctggtccatccctccctccgtgccgcgcccccctaggaccgccccctccccaaaaggcttttggatttgtgcatagctggagtgaaggcggagggagcctgctacaggccgcagcccaacccctgttttttattcagatttcccctcctttaccctttccctttttttttttttttttttttttaaagaaaccttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctcagtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttgagctgagtcctgagacacttagcttccctctccctcattcccggacccttccaccccactgggcccaaccatgggctcaggaccctggaattccgttttctgatttgctttgggattttttttttttttaagatgttacatggtgtttcgaagccagcaagttaccatcctccggtgtctcttctctccacatctgtaacttctttttccaggttttattttcagttttaaattcctaataaattatttgaaaacgtt

SEQ ID NO: 155942 - DNA, 698 bp, Homo sapiens
  Payload ID: 10625
  Gene Symbol: MSI1
  Gene Name: musashi RNA-binding protein 1
  ENST ID: ENST00000546985
  CDS Start-End: 1-698
tggaccaggcgggggtggataaagtgctggcgcaatcgcggcacgagctcgactccaaaacaattgaccctaaggtggccttccctcggcgagcacagcccaagatggtgactcgaacgaagaagatctttgtgggggggctgtcggtgaacaccacggtggaggacgtgaagcaatattttgagcagtttgggaaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgcccctggctacacctaccagttccccgccattcctctcactgcctacggaccaatggcggcggcagcggcggcagcggctgtggttcgagggacaggctctcacccctggacgatggctccccctccaggttcgactcccagccgcacagggggcttcctggggaccaccagccccggccccatggccgagctctac

SEQ ID NO: 155943 - DNA, 6364 bp, Homo sapiens
  Payload ID: 10626
  Gene Symbol: MSI2
  Gene Name: musashi RNA-binding protein 2
  Uniprot ID: Q96DH6
  ENST ID: ENST00000284073
  CDS Start-End: 210-1196
cggggctgagctaagccgagcccacgtgtgacggctctcgccgctgccccggctccgccgctcgcagagagattcggaggagcccgggcgggggggaggaggagggggaggagggagcggagatctcggggctcggagccggccgccgctccgctccgatcgctgtggggcttggttttttgggggtgggggggcgggggggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccaggcttcccagcagcggcttatggaccagtggcagcagcggcggtggcggcagcaagaggatcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacatttttttttgcttgttttggttctgttctcacttttaaaggatgctgagatggtaatatgactctccatattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactatagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaatagtaaattcccagaaattcagtgtttagacgagggaatttaattcctattttgtccatgttggtgatgtactgtacttcccttccttttctctgcatcccccatcacctcatagaagactctttgttgatcattgtatgttaataatgtataaaatggctatcttgtaagcgtgctgtcctggtactagtgtagcgactttttttctcctctttcttctagtacatattgataggtataacataattaaggtttaaaaaaaattagacatagttattcagatttaggaccagtaaggatagaactttctcttatttatgaaaaaaaatgctaataattttggggcagttttttcctttaattatttttttcaatttcaagtttaattttattttagctgatctgatgtggtttcaactaacccaaggtctcaccatgttaaaatgccggcggactctacggcgttttgtagatccccccccccccacccactgtgaaggggtgccatactaccttaaatgctaatgctagatatgcaaaactggatttttttaatttattttttaaaagagggaggcatggtatattaaaatgattttactaagagaaaaaatatttttttaagaatgctcagaagaaattgataatctgtgtgaatatgttttagatgtttatataccttttgaagagacccagtagcccatagcacaaatcttgtggaaatccgatatgttttaatgtggctacctaggtttaaggttcacgttagtccccccattccatctagaagtccattttgaaagatttttgtaaattcttttaacactgatgtttcagcctcgtctttgtttcagttaagctcaatggcgaacatgggaaccacctttcgccttccctgggggagaaaccctcttggctgatggcttttccccggaattatcaaacagccaccgggtgactttctggcttccagatccatctgcctgagacccccgaactcctctcctcccaagcagaggcgagtgagtggcattagctcccggacccattcccggtcctagctgggcatggggctgacggagatgaccaagccttggtctgctctctagcagcttccacagacttggctcgtggccttccttatatccactgggaacaaacagcctcgcgctctataccaaacagcctcgcgctctatcccagtcgcccattagcttgattcaaacaaagccccagcaggcctttgcgtttttatccttcataaccttcatcttaatttgaacttgtagcttggactttaaggtagcatggctctattgctgtcaatttactgtttcactgcacagcaatcacagccagtgaatgttacacacatcttgctagactagtataaaaatcattgggtaattgttggttctaatgacctgaaaggtgttcagtttttgttcttggttttgttttgtttttgatttcttgggggtgggttttgcttgttgttccttttcatttgggggtttttggggaaaaaatttatttttggttccaaatagaaaaacaaaacctattttgatctttagtgcaaacgagggctagggacttagcctcctccaccacctccacactgcttcattctgccattcactcactgcagcatattcaagaataaagcaatatcgtttactacattttttattgaaggtcagccatgctttctgtattatattgcatatgaaattgtttacaaaagaaacactaactcatacttctctttattggttgcaagtggcacgcaggaacagagggagagtggggggctggtgggggaggggagatttttttttttttttcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaacacaaaaacatataaataaaatccatccctcttgtcggggacctgcaggggggcaaccttaatccaaacacctggctatcaaataatcagaatgtattgtctcagacaggatttcagttccgggaggcaggggcatgatgggggagggggccggaggctgagagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtccagaaatcaatgtgtttgtctgacaaaaaaaaaaataaaataaaataaactgttttgaa

SEQ ID NO: 155944 - DNA, 1860 bp, Homo sapiens
  Payload ID: 10626
  Gene Symbol: MSI2
  Gene Name: musashi RNA-binding protein 2
  Uniprot ID: Q96DH6
  ENST ID: ENST00000322684
  CDS Start-End: 36-791
gctttccttttagcttttgtaagttacacgtcaaaatggccgatctgacatcggtgctcacttctgttatgttttctccctctagtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagactatttgccggtttcacaagacataatttttatcaactagctcttaagagaggcatagcaaagtgggggttgctaccatttctagagagagaggacacagtcccggcctgggctgcccccgctccagtcaatgctcactgaaagtctgtcttagctgcctgtttgaatgactgttctttttctcatttttaattcttggactcatgtcctcattgcttcactcaattaaaaaaaaattattctccagtcccctcccactttgcttcttgtatgcattgtgaccgaccccacttcctcagaatgtaacggggccagagggaaacttctcacaaacttcgtagagcctcctcaggggaagctaggaagaagacatcaaatgtttttaagtcatgaccaaacaggcttgttggggacatatcatggggtgagctttgaagtgctggtggtccagaggggttgcagatacgtgacttggagcacccgtgtcttacgatggacagtgataaaggtgaacacacagagacagactattctctaagaatgtgagaaacctgatctggaagaggagctatataaacactatctgactatctttgtcttttggggccagtggctgttggcataatcacaagcctgtctgtcttcgagaagggacagtggagtcatccaggtgctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcatttccctaactgaaatacacccactctcttggaataatgacgtaccactcagttggaccctcaagagtcactgctttgtctgtgctggtagtttgtgagaagtgacccgcacgcttccatttgatgcatttgatgtgagtgaatccatacatttgaatgtcattgtccttgagaccctacatgtgcagtttggctcatctcattaaagatgcttgatgt

SEQ ID NO: 155945 - DNA, 1624 bp, Homo sapiens
  Payload ID: 10626
  Gene Symbol: MSI2
  Gene Name: musashi RNA-binding protein 2
  ENST ID: ENST00000442934
  CDS Start-End: 41-844
tttctgttgtgtagttctgattttccgaacaggtgtttagatgatgaggggttatattaagaaagtactaaagaatacgtcttatcacgtgaatcagtatctttttattcaacatggatggagtgggagtggagaccaatctgttttatattcctgcaatctgatgaggatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccaggcttcccagcagcggcttatggaccagtggcagcagcggcggtggcggcagcaagaggatcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacatttttttttgcttgttttggttctgttctcacttttaaaggatgctgagatggtaatatgactctccatattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaag

SEQ ID NO: 155946 - DNA, 1714 bp, Homo sapiens
  Payload ID: 10626
  Gene Symbol: MSI2
  Gene Name: musashi RNA-binding protein 2
  ENST ID: ENST00000416426
  CDS Start-End: 136-1110
agagccagagagaacttccagcgcaaaaggaaaataaaacttgtggctggtgtttgtgcaggagggtctccgccatcctgaagccccccgatcctggggcgtctcgggggccgccaaaggagcgccagggttaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccaggcttcccagcagcggcttatggaccagtggcagcagcggcggtggcggcagcaagaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacatttttttttgcttgttttggttctgttctcacttttaaaggatgctgagatggtaatatgactctccatattttggtaccaattctgagactgtatgaattttcaggtggaactttagcacacactgaagcaaagttgtgaagtgcagggcgggaggtgggcgtgagct

SEQ ID NO: 155947 - DNA, 1635 bp, Homo sapiens
  Payload ID: 10626
  Gene Symbol: MSI2
  Gene Name: musashi RNA-binding protein 2
  Uniprot ID: Q96DH6
  ENST ID: ENST00000579180
  CDS Start-End: 106-561
caagtcagtcgatcctgtgtttgtgctcccgaaggacttggcgacttggctaacaaggagacatttgttatttcatttcctcatccattattcatgcagtgagagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagactatttgccggtttcacaagacataatttttatcaactagctcttaagagaggcatagcaaagtgggggttgctaccatttctagagagagaggacacagtcccggcctgggctgcccccgctccagtcaatgctcactgaaagtctgtcttagctgcctgtttgaatgactgttctttttctcatttttaattcttggactcatgtcctcattgcttcactcaattaaaaaaaaattattctccagtcccctcccactttgcttcttgtatgcattgtgaccgaccccacttcctcagaatgtaacggggccagagggaaacttctcacaaacttcgtagagcctcctcaggggaagctaggaagaagacatcaaatgtttttaagtcatgaccaaacaggcttgttggggacatatcatggggtgagctttgaagtgctggtggtccagaggggttgcagatacgtgacttggagcacccgtgtcttacgatggacagtgataaaggtgaacacacagagacagactattctctaagaatgtgagaaacctgatctggaagaggagctatataaacactatctgactatctttgtcttttggggccagtggctgttggcataatcacaagcctgtctgtcttcgagaagggacagtggagtcatccaggtgctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcatttccctaactgaaatacacccactctcttggaataatgacgtaccactcagttggaccctcaagagtcactgctttgtctgtgctggtagtttgtgagaagtgacccgcacgcttccatttgatgcatttgatgtgagtgaatccatacatttgaatgtcattgtccttgagaccctacatgtgcagtttggctcatctcattaaagatgcttgatgtaataa

SEQ ID NO: 155948 - DNA, 452 bp, Homo sapiens
  Payload ID: 10626
  Gene Symbol: MSI2
  Gene Name: musashi RNA-binding protein 2
  ENST ID: ENST00000579590
  CDS Start-End: 31-452
ccttttagcttttgtaagttacacgtcaaaatggccgatctgacatcggtgctcacttctgttatgttttctccctctagtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtttccgccggcagcccaggcctctccct

SEQ ID NO: 155949 - DNA, 493 bp, Homo sapiens
  Payload ID: 10626
  Gene Symbol: MSI2
  Gene Name: musashi RNA-binding protein 2
  ENST ID: ENST00000581776
  CDS Start-End: 4-303
gatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgtgcaggaggcagaagcggttggtttattgacatggaaacgaggatcttgtttactgttaccttaaaagctttgtttagattgaccccaaagttgcatttcctcgtcgagcgcaacccaagcattgctgactttcttcctccatggcacaggatttttgcccaaaacaaaagtctcaatttatttgttctttaaaaaaataaaaaccacactgaacaaaaa

SEQ ID NO: 155950 - DNA, 4538 bp, Homo sapiens
  Payload ID: 10627
  Gene Symbol: MRAS
  Gene Name: muscle RAS oncogene homolog
  Uniprot ID: O14807
  ENST ID: ENST00000289104
  CDS Start-End: 648-1274
attctcctgcctcagcctcccgagtagatgagatcacaggcacgtgccgccatgccgggttgacttttgtatttttagtagagacggggtttcaccatgttgcctaggctggtcttgaactcctgacctcaggcgattcacccgcctcggcctcccaaagtgttaggattacaggcgtgagccaccgcgcccggcttgaattgtacacttcaaaaggtggaattttatggtgttgaattatatctttatttttttaacggggggaaaatgacgccgctggagaggagttagcggaactgaaacaatgaaatggtgcgcgagtgtcgcctgtccccgtcgcatccatcccaacgaagtttgggccctggaacggtgcacccagaaggcctgcggggagagacgctggggcatgatctggaagaaagacgtctcaggattcgaagggaatgcagctaaggtggcggcggaggttcgcctaggactggggaggcgtccctaggctcagaagttggcccggccggagcggagatttaaaggttggagcgcagaggctcttaaagaggccgagtcgaattcccactcggcgtccaccttaaagccagctccccggcaccacggatctgacccgggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacg

SEQ ID NO: 155951 - DNA, 1803 bp, Homo sapiens
  Payload ID: 10627
  Gene Symbol: MRAS
  Gene Name: muscle RAS oncogene homolog
  Uniprot ID: O14807
  ENST ID: ENST00000423968
  CDS Start-End: 315-941
agggtcgaggcacccggcccgggctccccactggcgcgcccgcagcggcgctctatttttagcaggcgctgtggcaatataaggaatgcgcggcgcgctaggcgctcggggcgcacgctggcggcgcggtcgctttaaggaggcgccggggcggggacggaccggagtggccggctggcggggagccgtcagtccggcggccgcggggcccggcgggcgcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctga

SEQ ID NO: 155952 - DNA, 271 bp, Homo sapiens
  Payload ID: 10627
  Gene Symbol: MRAS
  Gene Name: muscle RAS oncogene homolog
  ENST ID: ENST00000475711
  CDS Start-End: 202-271
aggtgtggccgccctccgggctcggccgcgctctccgcttgcggggtgcgccctgggaccggctgtgcgtggcgttttgcccccatcgcgggctcccgcgtaacggtgtgcgttcgtgaaatcggccacgaccaagaccccagtggggagggcctgcgcgccgctcagagagaccctttcatggtctgacctacgagaaacatggcaaccagcgccgtccccagtgacaacctccccacatacaagctggtggtggtgggggatgggggtg

SEQ ID NO: 155953 - DNA, 431 bp, Homo sapiens
  Payload ID: 10627
  Gene Symbol: MRAS
  Gene Name: muscle RAS oncogene homolog
  ENST ID: ENST00000494949
  CDS Start-End: 110-431
cgctgcctcctcaccggcgcaggctaggagggggcggcctgagtgccgtagccgagccggggctggagcgcgcgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagcc

SEQ ID NO: 155954 - DNA, 856 bp, Homo sapiens
  Payload ID: 10627
  Gene Symbol: MRAS
  Gene Name: muscle RAS oncogene homolog
  Uniprot ID: O14807
  ENST ID: ENST00000474559
  CDS Start-End: 137-763
gctgtggtcacaactagggcctgggctcatgcattgaactgatctggctgaggcatcagacacggtgccagtcctgccctgcggggaagacaagagcacaaagtgacaagccagtgtggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaac

SEQ ID NO: 155955 - DNA, 1534 bp, Homo sapiens
  Payload ID: 10627
  Gene Symbol: MRAS
  Gene Name: muscle RAS oncogene homolog
  Uniprot ID: O14807
  ENST ID: ENST00000464896
  CDS Start-End: 219-617
aggtgtggccgccctccgggctcggccgcgctctccgcttgcggggtgcgccctgggaccggctgtgcgtggcgttttgcccccatcgcgggctcccgcgtaacggtgtgcgttcgtgaaatcggccacgaccaagaccccagtggggagggcctgcgcgccgctcagagagaccctttcatgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctg

SEQ ID NO: 155956 - DNA, 3801 bp, Homo sapiens
  Payload ID: 10627
  Gene Symbol: MRAS
  Gene Name: muscle RAS oncogene homolog
  Uniprot ID: O14807
  ENST ID: ENST00000621127
  CDS Start-End: 138-536
cggcggccgcggggcccggcgggcgcgacgctgcctcctcaccggcgcaggctaggagggggcggcctgagtgccgtagccgagccggggctggagcgcgcgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgt

SEQ ID NO: 155957 - DNA, 4377 bp, Homo sapiens
  Payload ID: 10627
  Gene Symbol: MRAS
  Gene Name: muscle RAS oncogene homolog
  Uniprot ID: O14807
  ENST ID: ENST00000614350
  CDS Start-End: 714-1112
agtagcgcaatctcggctcactacaacctctgcctcccgggttcacgtgattctcctgcctcagcctcccgagtagatgagatcacaggcacgtgccgccatgccgggttgacttttgtatttttagtagagacggggtttcaccatgttgcctaggctggtcttgaactcctgacctcaggcgattcacccgcctcggcctcccaaagtgttaggattacaggcgtgagccaccgcgcccggcttgaattgtacacttcaaaaggtggaattttatggtgttgaattatatctttatttttttaacggggggaaaatgacgccgctggagaggagttagcggaactgaaacaatgaaatggtgcgcgagtgtcgcctgtccccgtcgcatccatcccaacgaagtttgggccctggaacggtgcacccagaaggcctgcggggagagacgctggggcatgatctggaagaaagacgtctcaggattcgaagggaatgcagctaaggtggcggcggaggttcgcctaggactggggaggcgtccctaggctcagaagttggcccggccggagcggagatttaaaggttggagcgcagaggctcttaaagaggccgagtcgaattcccactcggcgtccaccttaaagccagctccccggcaccacggatctgacccggttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaggccctgggcacagtgacggtggcctggccagccctcgggacccctccccacctaactgcactgaaaccatttctaaccacaacccttggcccaaggacttggtacaggaagggagaagggcaggtgggcagggagcagacagggtctggctttgcccagagggcacgggctttcccacctctcaaagagacaaggaagccacctgtaagcagaagcagcatccaagtgcccctggcccccccatgtgttgattcaacccggttcctccccctctctcggtgggtgtgttgtttattgtaactacatagtgttggtttgatgtggaagtgtttatccacatacaaagtacaaaacaagccatgaacaagcttctttcccttaccccccatccacaatgtctgagcttggatgtcttttatagatttttaaattattttagtgattattattttattaaaggggtctgggctcactgcctggtgaagtttcaagtgttcagcagacctctctggtaacatatctggaatattgttgttgttttttaaccgagttttcccatcagtgccaaaactcaactcaatctgaaagtagagtgtctgagaggacagaaggtaatgggaactgtagctggaggcctcaggccatgggtcaaacctgggagggaaagagaccctacacatggcctagaaatgagagaagagagaggtatttacccagaggattttcctatggttggggatgcaaatattagaaaacagattgtattttgctgaggggagtggctgtcatgagcatgtcagttctaaaaggggttttcattatcctggaaatgtataaactaaagtaagctgattggctttgcaaacatgttcatttgtttttcagacagtatgggttaagttctctgccctccccaggggtctgaggaggctctgggtttctcagatctgtctcttgctgcgttttcacatcagctgtgctgcttggtgcctctctgatacgaatacactgacacgtcaaagtaacctaatgtggacaccatccagaaaactccagttcatgctggatcttaaccaaaaatgattcaatactgttatcactaaaacagcaccaagacctgaagccatcttcccttggagtcaactgactaccacctctataagcctagtcaatgagcagaccccttccagtatttgtaaaagtagtactaggttgcctttttggcaatttttattgacctgttgaatcttgactataaaatgatctgagaagtaaggaaggctgggctgatgtgtggctctcatataccttctgcaagggggcagtctccccagctccctgatgatgctcacccccgcccccccacctcaggtgctgctggtgtgagccaaagactggagtttttccagctggggtgggagtggagagacaacaggaacaacgctgcaccaaagaaaaggtcagaataaaaggcagcacagctggtgaccttattttctagatgttacaaatcaggtcactatgcaaactagaatatcctcagcaggtggcctggccactctggagaaagaaacccaaggaaagtgagcacccaactggatgccaagacacccgggttctgaaaatgtgctgtgttcctacctcggcaagatcaccagcactgaggggcccagctggagaatgattctgctacaaaaggagacagttgagacttttgcttgttggaaatcaaacttcttatttgtctaaattgcccctttttctgttcctaaaaggaaggataagagagaacattccaggtgaggcacttcaaagtttccttagaccctatagtgttaagaggtattttaaacactaaaaggacaaagctcttcccaatccttatgcttccctaagtggtatctgcagcagtttgttgtgtgcagtttgatggcagctgcaaactggaggtgaggcggaggaaaggcaggtaggaaggagtaaggatggagatgctcagaatcaagagcatggcggagtaggagaagaagccctgcacacagggcagtgtccacagccagaaaactcctgctgggcaccaaccactacgagcataccccatgcccaccgtggagctgcaactcctcgacagcactgagtttgatagtctcactggaagcagatcagctgatgtagaacagagacctcggccataaaggtgagaagacatagggatttcaaccacacagttgggacagaagggacagtgcatctgttcatccatcctgcacttggcccacgttgaactccatggtgcctgagagagactagttaagggttggtcttctgtatcctctgctgttgagcctctggtaagctttcatctcccatgaactcatttccccataaatgaaatgggtaaataatgccccatttgtagaagtgggccctcatgactgaggtagcttccagataggccagagtagagtgtagagtgtgccccgtgacatccctccatcttctcctccattatcatctagcagggtcagactgggaaacctggttggccacgccacaccatgaccgaggagccaactgggacttctggctgtttgacatcctcatgttcccgttggtcttccggagaatagtgctaccctcacatcccctggagcacagccttcctgaaatgccctcaccccatgcctttgccattgtgtgctctcagatttcttccactgtttgacaccctccttagagggctgctcttttttttccagagataatcctagccatcctctccactcccacggctggggacaatggccacttactacctgtgcactttgccactcgggacacctggatggtttctcttaggactttgcccacctccttctcatggcacttgctgtggaaaatgcctggctggcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgactgattaataaagaagagaaacacgt

SEQ ID NO: 155958 - DNA, 2408 bp, Homo sapiens
  Payload ID: 10628
  Gene Symbol: MUSK
  Gene Name: muscle, skeletal, receptor tyrosine kinase
  Uniprot ID: O15146
  ENST ID: ENST00000189978
  CDS Start-End: 47-2398
tgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggaagaaagtgaacccgaacaagatactaaagtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagaatggagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagcattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 155959 - DNA, 435 bp, Homo sapiens
  Payload ID: 10628
  Gene Symbol: MUSK
  Gene Name: muscle, skeletal, receptor tyrosine kinase
  ENST ID: ENST00000374439
  CDS Start-End: 1-399
aatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgagggtgctaaaggcattcacacccagtttgtggcttctgccctccagctaagatcgttccttagctgtccccaaatatgagaatgaatatacaatgataaaacaaaaataaatcaa

SEQ ID NO: 155960 - DNA, 2408 bp, Homo sapiens
  Payload ID: 10628
  Gene Symbol: MUSK
  Gene Name: muscle, skeletal, receptor tyrosine kinase
  ENST ID: ENST00000374440
  CDS Start-End: 47-2398
tgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggaagaaagtgaacccgaacaagatactaaagtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagattttagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagcattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 155961 - DNA, 2754 bp, Homo sapiens
  Payload ID: 10628
  Gene Symbol: MUSK
  Gene Name: muscle, skeletal, receptor tyrosine kinase
  Uniprot ID: O15146
  ENST ID: ENST00000374448
  CDS Start-End: 135-2744
gtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagaatggagtaaaccacagaaagataacaaaggctactgcgcccagtacagaggggaggtgtgtaatgcagtcctggcaaaagatgctcttgtttttctcaacacctcctatgcggaccctgaggaggcccaagagctactggtccacacggcctggaatgaactgaaagtagtgagcccagtctgccggccagctgctgaggctttgttgtgtaaccacatcttccaggagtgcagtcctggagtagtgcctactcctattcccatttgcagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagattataacaaagaaaacctaaaaacattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 155962 - DNA, 3344 bp, Homo sapiens
  Payload ID: 10628
  Gene Symbol: MUSK
  Gene Name: muscle, skeletal, receptor tyrosine kinase
  ENST ID: ENST00000416899
  CDS Start-End: 127-2712
gctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgtcctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagaatggagtaaaccacagaaagataacaaaggctactgcgcccagtacagaggggaggtgtgtaatgcagtcctggcaaaagatgctcttgtttttctcaacacctcctatgcggaccctgaggaggcccaagagctactggtccacacggcctggaatgaactgaaagtagtgagcccagtctgccggccagctgctgaggctttgttgtgtaaccacatcttccaggagtgcagtcctggagtagtgcctactcctattcccatttgcagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagcattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagacgttcaaataaaatgctgcagtttcctctcagactctgtgagccaggggaatcctacaccagaggcccaacaagacccacataggaaagagtaagagtaaacatgagtagtgtgttgtttgcttcccagggagagcaaagacagtgcaaaacccatgtggtagacggacccattgaaagccagtgattggaaacacaggctaggaaatgtgtcagataatggagacaactattcttcttcatgaaggtttgtaatacacactgcacagggaagaatgtcatcctgttcagtttccaaagtagctggtcacagagtaaagctctgctgtattaaattttaatatgaaatgggattcagagcttcattttttaattgagttaattcctgtccattgtgaaagtagcttaatcgtcatgtaagacacttaggtgaagtacagaaaactaaaaagaaggaaaagccactcattctgtctccccccaaagacgagtcttagtgttttattaaatctttcttgcatttaatgcataattttatatttgtttgtattctgcagagttgtggttacattttattgatagagggtttctaaggaatgaaacagcaaatcagcaagcctgtaa

SEQ ID NO: 155963 - DNA, 6422 bp, Homo sapiens
  Payload ID: 10629
  Gene Symbol: MBNL1
  Gene Name: muscleblind-like splicing regulator 1
  Uniprot ID: Q9NR56
  ENST ID: ENST00000282486
  CDS Start-End: 1843-3009
ttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 155964 - DNA, 6458 bp, Homo sapiens
  Payload ID: 10629
  Gene Symbol: MBNL1
  Gene Name: muscleblind-like splicing regulator 1
  ENST ID: ENST00000282488
  CDS Start-End: 1843-3045
ttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 155965 - DNA, 5225 bp, Homo sapiens
  Payload ID: 10629
  Gene Symbol: MBNL1
  Gene Name: muscleblind-like splicing regulator 1
  Uniprot ID: Q9NR56
  ENST ID: ENST00000324196
  CDS Start-End: 790-1812
gttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgttcccatggtgcacggtgctacgccagccactgtgtccgcagcaacaacatctgccacaagtgttcccttcgctgcaacagccacagccaaccagccccatccttgatgcttctacactgttgggtgcaacatcctgtcctgcagcagcaggaaaaatgatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 155966 - DNA, 5465 bp, Homo sapiens
  Payload ID: 10629
  Gene Symbol: MBNL1
  Gene Name: muscleblind-like splicing regulator 1
  Uniprot ID: Q9NR56
  ENST ID: ENST00000324210
  CDS Start-End: 920-2068
ccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaa

SEQ ID NO: 155967 - DNA, 5941 bp, Homo sapiens
  Payload ID: 10629
  Gene Symbol: MBNL1
  Gene Name: muscleblind-like splicing regulator 1
  Uniprot ID: Q9NR56
  ENST ID: ENST00000355460
  CDS Start-End: 1415-2527
cttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 155968 - DNA, 5256 bp, Homo sapiens
  Payload ID: 10629
  Gene Symbol: MBNL1
  Gene Name: muscleblind-like splicing regulator 1
  Uniprot ID: Q9NR56
  ENST ID: ENST00000357472
  CDS Start-End: 790-1818
gttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 155969 - DNA, 594 bp, Homo sapiens
  Payload ID: 10629
  Gene Symbol: MBNL1
  Gene Name: muscleblind-like splicing regulator 1
  ENST ID: ENST00000459747
  CDS Start-End: 420-594
attttcacagtttccccgcgccgcttcattgttcggactccggcgggtctgcccgtggctgaaggaggaagtgcgaggaggtgctcgccggccgcggttctcccgggcaggggcgggccgctcgcggtagttggtttcgcgtccctcagcacctcctgcccgggggaaggcgggagggtgagccgcagccgctcctgcgcccttccctgccgcgggctctgcggacgctgtcacggcacagcccgcgcacggcttggcagcccagcgggacccagggagaaacaggggggcgagaagagaaacagcagtcactcaggaaatgttgtttaaggggaaccttctggatccttttcatggcaccatggcaagaagaagctgtatcttatctatggaagataaagcatggagttggctaatggatgctgggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccg

SEQ ID NO: 155970 - DNA, 945 bp, Homo sapiens
  Payload ID: 10629
  Gene Symbol: MBNL1
  Gene Name: muscleblind-like splicing regulator 1
  Uniprot ID: Q9NR56
  ENST ID: ENST00000465907
  CDS Start-End: 1-945
atggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtag

SEQ ID NO: 155971 - DNA, 545 bp, Homo sapiens
  Payload ID: 10629
  Gene Symbol: MBNL1
  Gene Name: muscleblind-like splicing regulator 1
  ENST ID: ENST00000495875
  CDS Start-End: 276-545
acatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagagggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagactt

SEQ ID NO: 155972 - DNA, 5092 bp, Homo sapiens
  Payload ID: 10629
  Gene Symbol: MBNL1
  Gene Name: muscleblind-like splicing regulator 1
  Uniprot ID: Q9NR56
  ENST ID: ENST00000463374
  CDS Start-End: 512-1678
cgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 155973 - DNA, 989 bp, Homo sapiens
  Payload ID: 10629
  Gene Symbol: MBNL1
  Gene Name: muscleblind-like splicing regulator 1
  ENST ID: ENST00000464596
  CDS Start-End: 1-989
ctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagatacccataatatctgccgaacatctgactag

SEQ ID NO: 155974 - DNA, 4257 bp, Homo sapiens
  Payload ID: 10629
  Gene Symbol: MBNL1
  Gene Name: muscleblind-like splicing regulator 1
  Uniprot ID: Q9NR56
  ENST ID: ENST00000485910
  CDS Start-End: 512-1420
cgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaac

SEQ ID NO: 155975 - DNA, 1451 bp, Homo sapiens
  Payload ID: 10629
  Gene Symbol: MBNL1
  Gene Name: muscleblind-like splicing regulator 1
  ENST ID: ENST00000478535
  CDS Start-End: 1-633
cagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatggctctagccaacatgcagttacaacagcatacagcatttctcccaccaggctcaatattgtgcatgacacccgctacaagtgttgatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaac

SEQ ID NO: 155976 - DNA, 1023 bp, Homo sapiens
  Payload ID: 10629
  Gene Symbol: MBNL1
  Gene Name: muscleblind-like splicing regulator 1
  Uniprot ID: Q9NR56
  ENST ID: ENST00000485509
  CDS Start-End: 1-1023
atggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgttcccatggtgcacggtgctacgccagccactgtgtccgcagcaacaacatctgccacaagtgttcccttcgctgcaacagccacagccaaccagccccatccttgatgcttctacactgttgggtgcaacatcctgtcctgcagcagcaggaaaaatgatacccataatatctgccgaacatctgactagccacaagtatgttacccagatgtag

SEQ ID NO: 155977 - DNA, 4205 bp, Homo sapiens
  Payload ID: 10629
  Gene Symbol: MBNL1
  Gene Name: muscleblind-like splicing regulator 1
  ENST ID: ENST00000493459
  CDS Start-End: 322-1353
gaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagagcagtcactcaggaaatgttgtttaaggggaaccttctggatccttttcatggcaccatggcaagaagaagctgtatcttatctatggaagataaagcatggagttggctaatggatgctgataggaccatctagttgcaggaaaacaagctcagggctcccactgattctacattatgggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaa

SEQ ID NO: 155978 - DNA, 1054 bp, Homo sapiens
  Payload ID: 10629
  Gene Symbol: MBNL1
  Gene Name: muscleblind-like splicing regulator 1
  Uniprot ID: Q9NR56
  ENST ID: ENST00000492948
  CDS Start-End: 1-1029
atggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgatacccataatatctgccgaacatctgactagccacaagtatgttacccagatgtag

SEQ ID NO: 155979 - DNA, 5258 bp, Homo sapiens
  Payload ID: 10629
  Gene Symbol: MBNL1
  Gene Name: muscleblind-like splicing regulator 1
  ENST ID: ENST00000498502
  CDS Start-End: 790-1836
gttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaa

SEQ ID NO: 155980 - DNA, 898 bp, Homo sapiens
  Payload ID: 10629
  Gene Symbol: MBNL1
  Gene Name: muscleblind-like splicing regulator 1
  ENST ID: ENST00000460591
  CDS Start-End: 433-898
ggaaggtgtgagtccctctgagtcgagcggcgcgcgggtcttcccggcggctcccgcatccctggccccggggctgccatcccgcccggttttcatctgggccaaatatgtgcacgcaaaggttaattctctgcttgctacccataaattacgcatgacatgtttagctgggctgccttatatggagagtgctgtatttcaggccagtttgccttttgccaagtttacagggcggaagacgccctgtaggagagggctgcctcctccttttcttcttcttcttttttttttcatcgttttgtagtgcgtcactcaaaaactgtaagaaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatca

SEQ ID NO: 155981 - DNA, 5147 bp, Homo sapiens
  Payload ID: 10629
  Gene Symbol: MBNL1
  Gene Name: muscleblind-like splicing regulator 1
  Uniprot ID: Q9NR56
  ENST ID: ENST00000545754
  CDS Start-End: 790-1734
gttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 155982 - DNA, 4669 bp, Homo sapiens
  Payload ID: 10630
  Gene Symbol: MBNL2
  Gene Name: muscleblind-like splicing regulator 2
  Uniprot ID: Q5VZF2
  ENST ID: ENST00000345429
  CDS Start-End: 782-1885
tgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 155983 - DNA, 4596 bp, Homo sapiens
  Payload ID: 10630
  Gene Symbol: MBNL2
  Gene Name: muscleblind-like splicing regulator 2
  Uniprot ID: Q5VZF2
  ENST ID: ENST00000343600
  CDS Start-End: 841-1926
tcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagg

SEQ ID NO: 155984 - DNA, 4632 bp, Homo sapiens
  Payload ID: 10630
  Gene Symbol: MBNL2
  Gene Name: muscleblind-like splicing regulator 2
  Uniprot ID: Q5VZF2
  ENST ID: ENST00000376673
  CDS Start-End: 841-1962
tcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagg

SEQ ID NO: 155985 - DNA, 4487 bp, Homo sapiens
  Payload ID: 10630
  Gene Symbol: MBNL2
  Gene Name: muscleblind-like splicing regulator 2
  Uniprot ID: Q5VZF2
  ENST ID: ENST00000397601
  CDS Start-End: 731-1816
caggaaactccagcacctcctagaacatcttttgtggaatggcacctcatgggggcccttggatcatgtaccccttgtattcaacagtaaacatcttcctataatcattgcttcattaacgataatgtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 155986 - DNA, 581 bp, Homo sapiens
  Payload ID: 10630
  Gene Symbol: MBNL2
  Gene Name: muscleblind-like splicing regulator 2
  ENST ID: ENST00000449284
  CDS Start-End: 1-318
actcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaagg

SEQ ID NO: 155987 - DNA, 2574 bp, Homo sapiens
  Payload ID: 10630
  Gene Symbol: MBNL2
  Gene Name: muscleblind-like splicing regulator 2
  ENST ID: ENST00000469707
  CDS Start-End: 782-1549
tgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctaga

SEQ ID NO: 155988 - DNA, 1575 bp, Homo sapiens
  Payload ID: 10631
  Gene Symbol: MBNL3
  Gene Name: muscleblind-like splicing regulator 3
  Uniprot ID: Q9NUK0
  ENST ID: ENST00000370839
  CDS Start-End: 80-1084
aattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagataccccaattatcaatagatgaactgaatagcagcatgtttgtttcacagatgtagaagttctcagtagaacactgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccattt

SEQ ID NO: 155989 - DNA, 1643 bp, Homo sapiens
  Payload ID: 10631
  Gene Symbol: MBNL3
  Gene Name: muscleblind-like splicing regulator 3
  Uniprot ID: Q9NUK0
  ENST ID: ENST00000370844
  CDS Start-End: 405-1181
tgcccgcactccgagcgtgagccgcagcgcgactttttggcgctctttgggagcagtgagagagaggcggaggccagagagtccggggtgggcgcgggagccggggcggcccttggccgcattcccgcccgtcccgcagcggcgcgcggagccagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccattt

SEQ ID NO: 155990 - DNA, 1444 bp, Homo sapiens
  Payload ID: 10631
  Gene Symbol: MBNL3
  Gene Name: muscleblind-like splicing regulator 3
  Uniprot ID: Q9NUK0
  ENST ID: ENST00000370849
  CDS Start-End: 67-981
ggggctgagagtgtcttctactttactctgggcaaatgaaggcctgggagagcctgggctgattccatggagagggcttctaagaatcttaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttc

SEQ ID NO: 155991 - DNA, 2661 bp, Homo sapiens
  Payload ID: 10631
  Gene Symbol: MBNL3
  Gene Name: muscleblind-like splicing regulator 3
  Uniprot ID: Q9NUK0
  ENST ID: ENST00000370853
  CDS Start-End: 80-1144
aattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataa

SEQ ID NO: 155992 - DNA, 8760 bp, Homo sapiens
  Payload ID: 10631
  Gene Symbol: MBNL3
  Gene Name: muscleblind-like splicing regulator 3
  ENST ID: ENST00000370857
  CDS Start-End: 67-1095
tcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataaccaagcctcttttatgcttgtttggattcgtttgcctttatatatgtttgaaaatgacaatagaaagggttttatcaccctttgaatgagacagagtggctatactccacagagctcagctgagttcacattactaatatttatgaaagaattttacaaccaaataattcctgtggtgtgtgacatatctcatccactctactcatttattaatgttattatacagtggtggaaacacatgacattttacatcaagtaatagatttaatattttctagtaaataggcgctcttccaccagaaagtataaaaccatcatatacatatatatatatatatataatggtttttctccttcatgaaaatgacaagtaaaaagcaaatctgattgaggataccttaagctggctagaagtgtttgaatcacagaacaatggaattagcaaaatcctttttatagttgatggaactgaatccaggggcatatgacttgcccaaggctaccttagccattgtgggacccagaaatatctcctgcttcccattgttcctccttttcacattgtttttgcttcagaacatttgatgctctcttccaaagcagacccatttggctcagaatataagagagcaaaattagctttctgggaattgatactctgttgatcttaattatccatccaaatcctgatcaacagtgctttctaaacagccttgcttgtattgagtcattgtcagctgttgacaatgttgcgtggaattagagatcaagagttgtcctgacctttacctatggactctttgaaccagttaatttctatttctgaaatcttaacattgctatagaagaaagtagtgtatgcctttttgaaattcatcatgtatggaactgagttttgtatgatccgtgccagtgcctctccagaagggcagatctgattacatgaatccaggagggatgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggaaaaaaaatgctcctggcacaactttataactggcttcatttacattatacctgttcagtggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttcttg

SEQ ID NO: 155993 - DNA, 11263 bp, Homo sapiens
  Payload ID: 10631
  Gene Symbol: MBNL3
  Gene Name: muscleblind-like splicing regulator 3
  Uniprot ID: Q9NUK0
  ENST ID: ENST00000394311
  CDS Start-End: 138-914
ccttaaatttccttgcagctgatcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataaccaagcctcttttatgcttgtttggattcgtttgcctttatatatgtttgaaaatgacaatagaaagggttttatcaccctttgaatgagacagagtggctatactccacagagctcagctgagttcacattactaatatttatgaaagaattttacaaccaaataattcctgtggtgtgtgacatatctcatccactctactcatttattaatgttattatacagtggtggaaacacatgacattttacatcaagtaatagatttaatattttctagtaaataggcgctcttccaccagaaagtataaaaccatcatatacatatatatatatatatataatggtttttctccttcatgaaaatgacaagtaaaaagcaaatctgattgaggataccttaagctggctagaagtgtttgaatcacagaacaatggaattagcaaaatcctttttatagttgatggaactgaatccaggggcatatgacttgcccaaggctaccttagccattgtgggacccagaaatatctcctgcttcccattgttcctccttttcacattgtttttgcttcagaacatttgatgctctcttccaaagcagacccatttggctcagaatataagagagcaaaattagctttctgggaattgatactctgttgatcttaattatccatccaaatcctgatcaacagtgctttctaaacagccttgcttgtattgagtcattgtcagctgttgacaatgttgcgtggaattagagatcaagagttgtcctgacctttacctatggactctttgaaccagttaatttctatttctgaaatcttaacattgctatagaagaaagtagtgtatgcctttttgaaattcatcatgtatggaactgagttttgtatgatccgtgccagtgcctctccagaagggcagatctgattacatgaatccaggagggatgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggaaaaaaaatgctcctggcacaactttataactggcttcatttacattatacctgttcagtggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttcttggttatgtctttttttatgaatccatattcacacattaggagttcacttgaaggctattcatgctctagtatattaatcctaatatttagtaattctaaaatgaaatttaaatttctgatttggctcaatgttatatttcatacatagagtaaatttatttccaaatataccatcagtattttgaattatgtagataatatatccgttgtgttagacctattactcttataagattgaagttactgacacaagaaaaacacttctattttaataaaagaatacttaaaattttgagagaatgcttactagtttctcttgtgcctcagaaatcctgaggcatattctaagatgcattattagaagtttctctttcccagttattcatgtctatcctgcatccctagtgtaacatatgaaaccagtgttgtttatttcatactttccagatgggcatcaatcatttcataacaatgagatgcatgaatttttccattaaaatgttttctctcacttaaaattggttatcttcaacaaatggcacagtaataaaaggatgatcatttttgttctttaagaaagtaaatgtaatttagtaatactttattctgccttatttcaaaatgcttcaaaaatgcgaatctggaacttctctgcattgaccactgttctggagttgggctgatagaaaactgcggtgaagagagtttagatcagaggctatggcagagcaaagtattactgatgtgtctcttaacagtgaagagggtcggggaggaggttgggtccttgtcaagtgtcagctgccctatacatagttctcttgccccttgtgccctgttttactatttctaaggtggttcccatgatggcatttcttgataagcccactttgagccgtttaatgttttgtaggtgtttctgtgagtctgataataccagcactaaaaacagttcagtatatagacatttacaagaggtcttaggcctcttcagaattcagttaatgtctttctctttgaggctgctgaatgttaggtaagaattcagggcaagcattcccgaccatcatcaaattggagacttggagtttctattggctggaagaaagttgacccacaggcaaaaccagatgtaaaccaagtttgtcttgggtacttttcaaattcttttcacagcatccttttctcatccctcatggtggcctctggccctggaaaatcctcatgatagcaacttatcaggcctgtttcctctgatagatctggacttttccccttaagtgctttcctgttgggcttctcagactatggagaactgctcatagttgagatctaagagacaaattaccctatggtgttcaagaatggccgtatttagtatactgcctgtcctggaagtgttcacatttaaaaaggcatgactttccaatgggcaaatatcagacacctacatgcatagataagggaaatatgttttacttaagcaaacttctaggcattgaatctcagtgtttaggtgcagagatggaattcctataagcaatgcagtcattcaccacatcaggaaggccaaaaaatgaacactctcgtaattttgttattatctggaaagttctgatatgataatgaacctaaaatactgaatagatagtgaacatcctaaaattccactgaccagaatccattcccatggtcatcatctgtagagggcatgatacaatgacaggcctgaggtatgattataattctggagtaatttaaagcctatatttgttaaactttaacagatggacacacattctctgattttctacttggctctttcctgtactagaaatgcgcatttaactaaaccttcccagcttttctgttcagtgcctgacttacactactcccttaggcaggaggacagtgggtgtctggggaataaaagccaagagctccaaacagaggattttggatacaaagggcagccaccaggaaatagctttgtgagagggacagactatctgattcccatttgtacaaacatgtccaaagcaaaagcacagcattctaaagtggatgcagaaattagtatacaatggcagttctggccagtgcagcccagcatttttctgttgtgcatggaaagaacacagtgaaaaggcaggcagggcatccggtgcaaagtgcaacagacatagacacacaaatccagttttcctgatgagagagggagctatctcttcataagtgatgcaatgcaatgcaggcatgtacaagtacaaggaaagatttatttttaaaaaatcatagtgtaactggatgaataccagcaacagcacctgctaaagcaaacagcctgttcattaaaaactggacttgagggaatggagaaagaatctgaggagcctgcagtcagcatgcttgcagagaccttatggctacagaagacgatgattaacccatagaggttcaatgtagttttcaagaagagggtgggaaagcataagatggggactaagactttgcctttaaccttcatgacatgaagaattgaatgactctttgttggaaaaaatggcagttatgagataattggatccatgttaattatatatatttctgtatatatagtaagtggttattgatgtgcctttgttaaccatttcactatttaataaatgtgtgtgtagtttattc

SEQ ID NO: 155994 - DNA, 946 bp, Homo sapiens
  Payload ID: 10631
  Gene Symbol: MBNL3
  Gene Name: muscleblind-like splicing regulator 3
  ENST ID: ENST00000421707
  CDS Start-End: 277-946
atgcacccctgctaaaggctctcccggcaccggggccacctcgcgcagcgctgcttttgcttctgccgctaacagatggcatgtgccgctgtcgctgccgctgcccctgctgctgccgctgagagcagggccccttagcctctgggtttgcgctagcagcgtaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattg

SEQ ID NO: 155995 - DNA, 891 bp, Homo sapiens
  Payload ID: 10631
  Gene Symbol: MBNL3
  Gene Name: muscleblind-like splicing regulator 3
  ENST ID: ENST00000436215
  CDS Start-End: 165-891
ggggcggcccttggccgcattcccgcccgtcccgcagcggcgcgcggagccagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgcca

SEQ ID NO: 155996 - DNA, 840 bp, Homo sapiens
  Payload ID: 10631
  Gene Symbol: MBNL3
  Gene Name: muscleblind-like splicing regulator 3
  ENST ID: ENST00000442191
  CDS Start-End: 1-453
atcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagataccccaattatcaatagatgaactgaatagcagcatgtttgtttcacagatgtagaagttctcagtagaacactgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttgg

SEQ ID NO: 155997 - DNA, 11294 bp, Homo sapiens
  Payload ID: 10631
  Gene Symbol: MBNL3
  Gene Name: muscleblind-like splicing regulator 3
  Uniprot ID: Q9NUK0
  ENST ID: ENST00000538204
  CDS Start-End: 67-945
ggggctgagagtgtcttctactttactctgggcaaatgaaggcctgggagagcctgggctgattccatggagagggcttctaagaatcttaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataaccaagcctcttttatgcttgtttggattcgtttgcctttatatatgtttgaaaatgacaatagaaagggttttatcaccctttgaatgagacagagtggctatactccacagagctcagctgagttcacattactaatatttatgaaagaattttacaaccaaataattcctgtggtgtgtgacatatctcatccactctactcatttattaatgttattatacagtggtggaaacacatgacattttacatcaagtaatagatttaatattttctagtaaataggcgctcttccaccagaaagtataaaaccatcatatacatatatatatatatatataatggtttttctccttcatgaaaatgacaagtaaaaagcaaatctgattgaggataccttaagctggctagaagtgtttgaatcacagaacaatggaattagcaaaatcctttttatagttgatggaactgaatccaggggcatatgacttgcccaaggctaccttagccattgtgggacccagaaatatctcctgcttcccattgttcctccttttcacattgtttttgcttcagaacatttgatgctctcttccaaagcagacccatttggctcagaatataagagagcaaaattagctttctgggaattgatactctgttgatcttaattatccatccaaatcctgatcaacagtgctttctaaacagccttgcttgtattgagtcattgtcagctgttgacaatgttgcgtggaattagagatcaagagttgtcctgacctttacctatggactctttgaaccagttaatttctatttctgaaatcttaacattgctatagaagaaagtagtgtatgcctttttgaaattcatcatgtatggaactgagttttgtatgatccgtgccagtgcctctccagaagggcagatctgattacatgaatccaggagggatgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggaaaaaaaatgctcctggcacaactttataactggcttcatttacattatacctgttcagtggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttcttggttatgtctttttttatgaatccatattcacacattaggagttcacttgaaggctattcatgctctagtatattaatcctaatatttagtaattctaaaatgaaatttaaatttctgatttggctcaatgttatatttcatacatagagtaaatttatttccaaatataccatcagtattttgaattatgtagataatatatccgttgtgttagacctattactcttataagattgaagttactgacacaagaaaaacacttctattttaataaaagaatacttaaaattttgagagaatgcttactagtttctcttgtgcctcagaaatcctgaggcatattctaagatgcattattagaagtttctctttcccagttattcatgtctatcctgcatccctagtgtaacatatgaaaccagtgttgtttatttcatactttccagatgggcatcaatcatttcataacaatgagatgcatgaatttttccattaaaatgttttctctcacttaaaattggttatcttcaacaaatggcacagtaataaaaggatgatcatttttgttctttaagaaagtaaatgtaatttagtaatactttattctgccttatttcaaaatgcttcaaaaatgcgaatctggaacttctctgcattgaccactgttctggagttgggctgatagaaaactgcggtgaagagagtttagatcagaggctatggcagagcaaagtattactgatgtgtctcttaacagtgaagagggtcggggaggaggttgggtccttgtcaagtgtcagctgccctatacatagttctcttgccccttgtgccctgttttactatttctaaggtggttcccatgatggcatttcttgataagcccactttgagccgtttaatgttttgtaggtgtttctgtgagtctgataataccagcactaaaaacagttcagtatatagacatttacaagaggtcttaggcctcttcagaattcagttaatgtctttctctttgaggctgctgaatgttaggtaagaattcagggcaagcattcccgaccatcatcaaattggagacttggagtttctattggctggaagaaagttgacccacaggcaaaaccagatgtaaaccaagtttgtcttgggtacttttcaaattcttttcacagcatccttttctcatccctcatggtggcctctggccctggaaaatcctcatgatagcaacttatcaggcctgtttcctctgatagatctggacttttccccttaagtgctttcctgttgggcttctcagactatggagaactgctcatagttgagatctaagagacaaattaccctatggtgttcaagaatggccgtatttagtatactgcctgtcctggaagtgttcacatttaaaaaggcatgactttccaatgggcaaatatcagacacctacatgcatagataagggaaatatgttttacttaagcaaacttctaggcattgaatctcagtgtttaggtgcagagatggaattcctataagcaatgcagtcattcaccacatcaggaaggccaaaaaatgaacactctcgtaattttgttattatctggaaagttctgatatgataatgaacctaaaatactgaatagatagtgaacatcctaaaattccactgaccagaatccattcccatggtcatcatctgtagagggcatgatacaatgacaggcctgaggtatgattataattctggagtaatttaaagcctatatttgttaaactttaacagatggacacacattctctgattttctacttggctctttcctgtactagaaatgcgcatttaactaaaccttcccagcttttctgttcagtgcctgacttacactactcccttaggcaggaggacagtgggtgtctggggaataaaagccaagagctccaaacagaggattttggatacaaagggcagccaccaggaaatagctttgtgagagggacagactatctgattcccatttgtacaaacatgtccaaagcaaaagcacagcattctaaagtggatgcagaaattagtatacaatggcagttctggccagtgcagcccagcatttttctgttgtgcatggaaagaacacagtgaaaaggcaggcagggcatccggtgcaaagtgcaacagacatagacacacaaatccagttttcctgatgagagagggagctatctcttcataagtgatgcaatgcaatgcaggcatgtacaagtacaaggaaagatttatttttaaaaaatcatagtgtaactggatgaataccagcaacagcacctgctaaagcaaacagcctgttcattaaaaactggacttgagggaatggagaaagaatctgaggagcctgcagtcagcatgcttgcagagaccttatggctacagaagacgatgattaacccatagaggttcaatgtagttttcaagaagagggtgggaaagcataagatggggactaagactttgcctttaaccttcatgacatgaagaattgaatgactctttgttggaaaaaatggcagttatgagataattggatccatgttaattatatatatttctgtatatatagtaagtggttattgatgtgcctttgttaaccatttcactatttaataaatgtgtgtgtagtttattc

SEQ ID NO: 155998 - DNA, 2615 bp, Homo sapiens
  Payload ID: 10632
  Gene Symbol: MURC
  Gene Name: muscle-related coiled-coil protein
  Uniprot ID: Q5BKX8
  ENST ID: ENST00000307584
  CDS Start-End: 66-1160
gactttttgctccaagtgccagaattgattgtggttaggacatcttacgctgagaaataaataaaatggaacataatgggtctgcttcaaatgctgataaaatccaccagaatcgcctgtcgagtgttacagaagatgaagaccaagacgctgctcttaccattgtgactgtgctggacaaagtagcctccatcgtggacagtgtgcaggcaagccagaagagaatagaagagagacacagggaaatggaaaatgccataaaatccgtccagattgacctgttgaagctttcacagtcgcatagcaatacagggcatatcattaacaaattgtttgagaaaacccgaaaagttagtgctcacattaaagatgtgaaagcccgggtggagaagcaacaaattcatgttaaaaaagttgaagtcaagcaagaggaaataatgaagaaaaacaaattccgcgtggtaatattccaggagaagtttcggtgtccgacatccctgtctgttgttaaagacagaaacctaactgagaaccaagaagaggatgatgatgatatctttgatcccccagtagatctgtcttcggatgaagaatattatgttgaagaaagcagatctgccaggcttaggaagtcaggcaaggagcacattgataatatcaagaaggcattttccaaagaaaacatgcagaagacacggcagaatcttgacaagaaagtgaacagaattagaactagaatagtgaccccggagaggagagagaggctaaggcagtcaggagagaggctgagacagtcaggggagaggctgagacagtcaggggagaggtttaagaaatctatttctaatgcagctccctcaaaggaagcttttaagatgcgcagcctcaggaaaggtaaggaccgaacagtggctgaaggtgaggaatgtgccagggagatgggtgtggacatcattgccaggagcgagtctctgggccccatcagtgagctctactctgatgagctcagtgaaccagaacacgaggcagccaggccggtgtatcctccccatgaaggaagggaaatccccacccccgagcctttaaaagttacttttaaatctcaggtgaaagtagaggatgatgaatctcttttgttagatttaaagcactcatcgtaaagaggaattaagtatatcctaaatatgaatctcctaatcatgcagttttagtttgaatagtgtagtcgtctacatttctgtgccatgtaggaaaacataaatgtattttttttcttatatttaaaatcttgaagataatataaatattattatcactctttctcatggcagctgtggattttttagttcctttctcttgtccaccagaaaaatagtttcctaggttgggccagttacgtgtttggtaagggcaactttgcggccgtcatttgcaggagaactctaaatattggttaggattaatattgtggccagcctcaaaggggaataactcatgtgtgggttatatcgtccagatgttcagatcaacagatttgttagtaaattagcagtcacaccccttttttgatgctttcacattaaaaaattgaagttttggacttgagcatttggctctagtatcatagctttacttataagaaaaccctgggcaagtcatctgcttattctcatcagtaaaaatggagagggttggcctctgctgcctgcctcagaggactgttgtgatgatcaaaggaaatggtacacattctgggggaacaagaagcacacccagagaaaacaagcctcatcagttcctccaaaacagaatggaaagagttacaccttctgaaaaagccctcagcaccaatcaataaggtcctaggttggagagaaactaaagctggtcttcagaagccttttcacagaatcaagagtgaaaaataagtaaatgtttgggtgaccactttttcatcagactaactatatcttgggttttagttgggtctcaaaatgttccccagccagaccctttctaatttccttttgattaagatctttggtggactatagcactaaatttgtttaagcagtatgaggcataaaattgtgactatgtttctaaagtcggccctgatgcattgggtttggaaatgaccacaaatattcctgttttcctgagtgtacccttcagggtccagctgtccaaaacagtgttgataggagttcatcatagctgctttgggaggaagccagattctccttatcttttagctttagatcgtggaatccaggaagtagaacaatgtctattgttgctaaagaaagaaagaaatgggccgggtgtggtggctcacggggagtaatcccagcactttgcgaggccgaggtgggtgaatcacctgaggtcagaagttcacgaccagcctgaccaacatggcgaaaccctgactctactgaaaatacaaaaattagctgggcatggtggcatgcgcctgtcccagctactcaggaggctgagacaggagaattgcctgaacccaggaggcggaggttgcagtgagccgagattgtgccactgcactcaagcctgggcaaaagagccagactctgtttcaaaaaaaaagaaaaaaa

SEQ ID NO: 155999 - DNA, 1815 bp, Homo sapiens
  Payload ID: 10633
  Gene Symbol: MLIP
  Gene Name: muscular LMNA-interacting protein
  Uniprot ID: Q5VWP3
  ENST ID: ENST00000274897
  CDS Start-End: 114-1490
acaacttggaatgtcctgcaatatctaacatgtaagcacgtcgaatcattttctagacagaatctgaacctctgtgtctctcagtctttctctctttctcattctctttcaatatggaacttgaaaagcgtgaaaaaagaagcttattaaacaagaatttagaggagaaactgacggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagctctattttcctgcacagctcaggcagcaaactgaagagctctgtgctaccattgataaggtcttacaggattccttgtctatgcattcttctgattctccttcaaggtccccaaagacattgttgggttctgacacagtcaaaactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatagaa

SEQ ID NO: 156000 - DNA, 1076 bp, Homo sapiens
  Payload ID: 10633
  Gene Symbol: MLIP
  Gene Name: muscular LMNA-interacting protein
  Uniprot ID: Q5VWP3
  ENST ID: ENST00000370876
  CDS Start-End: 47-751
actgctttcttgacatctgctagtttgacacgtggcaccggattccatgtgcagctggtaccttggatttgaatgttcttctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatagaa

SEQ ID NO: 156001 - DNA, 1234 bp, Homo sapiens
  Payload ID: 10633
  Gene Symbol: MLIP
  Gene Name: muscular LMNA-interacting protein
  ENST ID: ENST00000370877
  CDS Start-End: 103-909
tgtcctgcaatatctaacatgtaagcacgtcgaatcattttctagacagaatctgaacctctgtgtctctcagtctttctctctttctcattctctttcaatatggaacttgaaaagcgtgaaaaaagaagcttattaaacaagaatttagaggagaaactgacgtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcaggcactagatgaaccagccaagactgaaagtgtctccaaggacaacacattagaaccaccagtggagcattcttctgattctccttcaaggtccccaaagacattgttgggttctgacacagtcaaaactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatagaa

SEQ ID NO: 156002 - DNA, 941 bp, Homo sapiens
  Payload ID: 10633
  Gene Symbol: MLIP
  Gene Name: muscular LMNA-interacting protein
  ENST ID: ENST00000447836
  CDS Start-End: 354-941
agcatattggaatctaaggcttatagattgccagcctgctcagcgtctctaacccttttcaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaa

SEQ ID NO: 156003 - DNA, 989 bp, Homo sapiens
  Payload ID: 10633
  Gene Symbol: MLIP
  Gene Name: muscular LMNA-interacting protein
  ENST ID: ENST00000514433
  CDS Start-End: 1-989
tgcgggaacaattacttccaaatgacctcgtgcatcttatcagggagcattcagaccacaccccaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcaggcactagatgaaccagccaagactgaaagtgtctccaaggacaacacattagaaccaccagtggagactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccaca

SEQ ID NO: 156004 - DNA, 360 bp, Homo sapiens
  Payload ID: 10633
  Gene Symbol: MLIP
  Gene Name: muscular LMNA-interacting protein
  ENST ID: ENST00000460844
  CDS Start-End: 351-360
cataatttgtacagtgctttgtcatctttgcagctcatcaatatcagcagctgacacaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaa

SEQ ID NO: 156005 - DNA, 571 bp, Homo sapiens
  Payload ID: 10633
  Gene Symbol: MLIP
  Gene Name: muscular LMNA-interacting protein
  ENST ID: ENST00000505762
  CDS Start-End: 240-571
ttgctcttggttttaatccttttggaatgtcttgagggtcaggagcgttgccattgatggctatgggagttgtcaggctgtggctctctttctcacagagaatgccagaggcactcgggaaggcatttgccagggctctgacagatgtaaagtaagccttatccatgttgtgttctcacctggacacctggaaggtgctcagtatagaaaagtcacgagctagatgagataccagcttgatgtcgactccctccccaacaatggctgcctgtcttcgtcttgatgcctgccagcaggaaagcactgtcttagaacctggctcacctgattttgccgatgagtcaactttgaagtgtgcctcattctggaaagtgaatcacgtaatcacatctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtgga

SEQ ID NO: 156006 - DNA, 5743 bp, Homo sapiens
  Payload ID: 10633
  Gene Symbol: MLIP
  Gene Name: muscular LMNA-interacting protein
  Uniprot ID: Q5VWP3
  ENST ID: ENST00000514921
  CDS Start-End: 114-2861
acaacttggaatgtcctgcaatatctaacatgtaagcacgtcgaatcattttctagacagaatctgaacctctgtgtctctcagtctttctctctttctcattctctttcaatatggaacttgaaaagcgtgaaaaaagaagcttattaaacaagaatttagaggagaaactgacggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagttaacttcttctcccactacctctgagcagcttgcctgtaaaccacctgctttctcctttgtttctccaactaatccgaacacaccacccgacccagttaacctcgagggagcctctgtcctagaggagttccacactaggaggctggatgtcggtggggccgtggtggaagaatcagctacgtattttcaaactaccgctcactctacacccttttctgcatcgaagggcacctcctcgacgttactgtttccccattccactcaactatcaggttctaatttacccagttcaactgcagcagatccaaagcctggactgacctctgaagttctcaagaagacaactttaacctcgcatgtccttagtcacggagaaagtccgagaacctcttcttctccaccgtcctccagtgcttctctgaagtcgaattcggcctcgtacataccagtccgcattgtcacgcattcactctctccgagccccaaaccatttacctcctctttccacggctcttcttccaccatctgcagccaaatgtcatctagtggaaatctttcaaagtcaggggtaaaatccccggtgccttcccggcttgcccttctcactgccattctcaagtcaaacccttcccaccaaagacccttttcccctgcatcctgtcccaccttctctctcaactccccggcctcttccacgctcacacttgaccaaaaagaaaagcagaccccacccacgcctaaaaaatctctctcaagttgttccctgagagccgggtcaccagatcaaggggaactccaggtttctgaattgacccagcaatcttttcacctgcctgttttcaccaagtctactccgctttctcaggcgccctccctctctcctacaaaacaggctagtagcagccttgcttccatgaatgtagagagaacaccatcacctactttgaagagcaataccatgctctccctgctacaaaccagtacatccagttctgtgggtcttcctcctgttccaccaagctcttctctttcctctttgaagagtaaacaggatggtgacctcaggggtccagaaaaccccagaaacattcacacgtacccttctacattagcctcctctgcattatcttctctatctcctcctattaatcaaagagctacgttctcttcttcagagaaatgtttccatccttccccagctctttcaagcctgataaacagatctaaaagagcatcatcccaactatctggccaggagctgaatccttcagctcttccttcactccctgtctccagtgctgactttgcctctcttcccaacttgaggtcctcctctctccctcatgccaatctgcccaccctggtgccccagctcagtccctcagctctgcacccacattgcggcagtggtaccttgccttcaagacttgggaaatctgaaagcaccacccccaaccacaggtcacctgtttcaaccccatcacttcccatatctctaacaaggacagaggagctgatttcaccttgtgcattgtccatgtcaacaggcccagaaaataagaaatcaaagcaatacaagaccaagtcaagctacaaggcttttgcagcaatccctacaaacacattgcttttggaacagaaggcactagatgaaccagccaagactgaaagtgtctccaaggacaacacattagaaccaccagtggagctctattttcctgcacagctcaggcagcaaactgaagagctctgtgctaccattgataaggtcttacaggattccttgtctatgcattcttctgattctccttcaaggtccccaaagacattgttgggttctgacacagtcaaaactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggctgcacattctgtggactcctactgcaacggaagtgacacgtctggtccttggctcctctgatcattgaggaaccctatccttgtggctagttactgtagcctttgactttcctacttcctgaaaaagagaaaaagacgatgatagaattcaatggcaagaacatgggctcttgtgatttttgaaaaaatcagtccttactgaacttcaattttatcctacaaaaatggggctactaatcaccatttctaatggaacccatactaataagtatttgtgatttttttaaaagtataatttctttaaattttttccaagtgctttcatctttattgcagtataattgacaaaaattatacctatttaaggtgtaaaatgtgatgatttgatgtatgtgtacattgtataatgattaccacagttaaattaatcaatgtaactattaatgtactagttactctgtgtgtgtatatgggagaagagatgaggacacataaaatctattctcagcaaatttcaagtaaaaagtaaaatattattaactgtagtcaccatgctatacattagctctccagaacttattcctttgataactgaatgtttctaccctttaaacaccatttttccttttcacttaaatcccttattaagacaataatagattcaaaacaacaaaacatccatttcaaccaaaagtccattccaacccctggcaaccatcattctactctttgcttctgtaattctgactattttagattccactaaagtgagatcacgcaatatttgtccttttgtgactggctcatttcacttggcataatatatttggaattcattcatgttattggaaatggcaggatttctttcttttttaaggctgaataatatttcattgtttaacacgttttatttattcatttatccatcaacagacacttcggttgttgccatatctaattgttaagaatgatactgcaatggttgaatgaaatactcactatcaaagggctctaaagacttaaatgtttcttgttatcatttcctttagaatcacttcaattttggaagaaagaggttgatttcctgctaaagggtcaactgaatatattgtcttctttctctcttccattatgagcaattgtagaagcctattttctatgttacttttgacttcttcaattttaactgctcctccatcctaaacacctccacatgggaaataaaagaccagaatccaactatatgtatagaaaaacataaaactcagcattgtagtcctctgctgctcactgtgattgattatggagtgtttttctttcttttcccttgagtgtacctccatcagatacttccatgctgatccatgccatctgttctgtgaaacttgctgtcagacaaccatacactttaagcactaagttatccaaattctatcttaaaaattatgttgtgattattaaaaatctttttttatatagaggatttcaaatagctaagcatatgctaaatttttcatacttcacaagttcaaattttcttggttcaaatcaggattcaaaatatatgtgttgctttaaatatgtctgtttgaaaaaatgcatatggattctccaaaatttgggtttctaagcaagaagatatgccatataatcgaaaccaatttatattggctttatcttagtgaaatgtagataatcacaatctcttatttcatagtaacatgaggtttttgtgatgctgtctgtaaagtgttggtgtctttagataaaggggtcgctctttaagaaaatattactactgttcatgattttattagcaaggtgttgatttaaattaaaactgtagcaaaaatgctatggctctgattttaaactgctgtaagttctagacagcaaaggaaagctgaaaataaatgctgcatttaaaaataaatgttgctttaccaaagaggtgggaagatggaagacaggatggagtgaaaggctccagtaattttacctatggtactctgagttcacaaaggtgtcttgtactcagacagaaaaccgcagcgtgaagaggggacagcatgagtgaagaggaagtgaattttcacccttcacttccaaaccacaggaaaggaagtgactttaaaatgccaggatggaacaaaagcatttcagatgtgcaggctttaataagaagagctcaaaatgccgtaaaatgccctttgatgttgcaatggaaacagtttttgaagttaaacagtatgatttgatggttgagtagaaagtaggctttttctagagcaccaaatgcatcagatatggctataacactaattttctgatgtgtctgtcagttaagcagagctaaattaatatattcactgcatatttgtctgctaatttttctttaatgaacaaagatattacttgcttcataagttcctgtcttcttgaagttttgtagaatgatagtatcatctcaaaaataattaattcttttcaaaaatcaagctcctcagtaaagcctttttttgaaacattagttctatgtatactgaaattgaaagaggacaattctcaagtgactaaaaagcggtttaaagcattttatcagaaataactatgttacctatctcattgatagaaacatgtccaagactgttttatgatccctgtacatccctcaaaaactaaaacattaaaagattcatatattgcatgctaaagcaggatagagtgatgttcattttcaagaatcatttagaatagtgatctctaaagtattaggtaccaacctcaagataattcgctggggtggaagtagggcacaagttagacgtgatagagatgccattagtgtgttttgaagcaaatctcaaacaggggtcacaaactatggtctgtgggccaaacctggctcaccagtgtttttataaataaagtattattggaaca

SEQ ID NO: 156007 - DNA, 3102 bp, Homo sapiens
  Payload ID: 10633
  Gene Symbol: MLIP
  Gene Name: muscular LMNA-interacting protein
  Uniprot ID: Q5VWP3
  ENST ID: ENST00000502396
  CDS Start-End: 33-3014
ttggtttgctcgctcccttatgtgatgaatcaatgctttcagaacaggggcttctgagtgactgcgggaacaattacttccaaatgacctcgtgcatcttatcagggagcattcagaccacaccccaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagttaacttcttctcccactacctctgagcagcttgcctgtaaaccacctgctttctcctttgtttctccaactaatccgaacacaccacccgacccagttaacctcgagggagcctctgtcctagaggagttccacactaggaggctggatgtcggtggggccgtggtggaagaatcagctacgtattttcaaactaccgctcactctacacccttttctgcatcgaagggcacctcctcgacgttactgtttccccattccactcaactatcaggttctaatttacccagttcaactgcagcagatccaaagcctggactgacctctgaagttctcaagaagacaactttaacctcgcatgtccttagtcacggagaaagtccgagaacctcttcttctccaccgtcctccagtgcttctctgaagtcgaattcggcctcgtacataccagtccgcattgtcacgcattcactctctccgagccccaaaccatttacctcctctttccacggctcttcttccaccatctgcagccaaatgtcatctagtggaaatctttcaaagtcaggggtaaaatccccggtgccttcccggcttgcccttctcactgccattctcaagtcaaacccttcccaccaaagacccttttcccctgcatcctgtcccaccttctctctcaactccccggcctcttccacgctcacacttgaccaaaaagaaaagcagaccccacccacgcctaaaaaatctctctcaagttgttccctgagagccgggtcaccagatcaaggggaactccaggtttctgaattgacccagcaatcttttcacctgcctgttttcaccaagtctactccgctttctcaggcgccctccctctctcctacaaaacaggctagtagcagccttgcttccatgaatgtagagagaacaccatcacctactttgaagagcaataccatgctctccctgctacaaaccagtacatccagttctgtgggtcttcctcctgttccaccaagctcttctctttcctctttgaagagtaaacaggatggtgacctcaggggtccagaaaaccccagaaacattcacacgtacccttctacattagcctcctctgcattatcttctctatctcctcctattaatcaaagagctacgttctcttcttcagagaaatgtttccatccttccccagctctttcaagcctgataaacagatctaaaagagcatcatcccaactatctggccaggagctgaatccttcagctcttccttcactccctgtctccagtgctgactttgcctctcttcccaacttgaggtcctcctctctccctcatgccaatctgcccaccctggtgccccagctcagtccctcagctctgcacccacattgcggcagtggtaccttgccttcaagacttgggaaatctgaaagcaccacccccaaccacaggtcacctgtttcaaccccatcacttcccatatctctaacaaggacagaggagctgatttcaccttgtgcattgtccatgtcaacaggcccagaaaataagaaatcaaagcaatacaagaccaagtcaagctacaaggcttttgcagcaatccctacaaacacattgcttttggaacagaaggcactagatgaaccagccaagactgaaagtgtctccaaggacaacacattagaaccaccagtggagctctattttcctgcacagctcaggcagcaaactgaagagctctgtgctaccattgataaggtcttacaggattccttgtctatgcattcttctgattctccttcaaggtccccaaagacattgttgggttctgacacagtcaaaactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagttttttggaatgctggtgctaaccacttgctagatttaactttttttttttt

SEQ ID NO: 156008 - DNA, 1746 bp, Homo sapiens
  Payload ID: 10633
  Gene Symbol: MLIP
  Gene Name: muscular LMNA-interacting protein
  ENST ID: ENST00000503951
  CDS Start-End: 63-1746
tagtatgaggctcccttcccacctcagtcattggtttgctcgctcccttatgtgatgaatcaatgctttcagaacaggggcttctgagtgactgcgggaacaattacttccaaatgacctcgtgcatcttatcagggagcattcagaccacaccccagtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagttaacttcttctcccactacctctgagcagcttgcctgtaaaccacctgctttctcctttgtttctccaactaatccgaacacaccacccgacccagttaacctcgagggagcctctgtcctagaggagttccacactaggaggctggatgtcggtggggccgtggtggaagaatcagctacgtattttcaaactaccgctcactctacacccttttctgcatcgaagggcacctcctcgacgttactgtttccccattccactcaactatcaggttctaatttacccagttcaactgcagcagatccaaagcctggactgacctctgaagttctcaagaagacaactttaacctcgcatgtccttagtcacggagaaagtccgagaacctcttcttctccaccgtcctccagtgcttctctgaagtcgaattcggcctcgtacataccagtccgcattgtcacgcattcactctctccgagccccaaaccatttacctcctctttccacggctcttcttccaccatctgcagccaaatgtcatctagtggaaatctttcaaagtcaggggtaaaatccccggtgccttcccggcttgcccttctcactgccattctcaagtcaaacccttcccaccaaagacccttttcccctgcatcctgtcccaccttctctctcaactccccggcctcttccacgctcacacttgaccaaaaagaaaagcagaccccacccacgcctaaaaaatctctctcaagttgttccctgagagccgggtcaccagatcaaggggaactccaggtttctgaattgacccagcaatcttttcacctgcctgttttcaccaagtctactccgctttctcaggcgccctccctctctcctacaaaacaggctagtagcagccttgcttccatgaatgtagagagaacaccatcacctactttgaagagcaataccatgctctccctgctacaaaccagtacatccagttctgtgggtcttcctcctgttccaccaagctcttctctttcctctttgaagagtaaacaggatggtgacctcaggggtccagaaaaccccagaaacattcacacgtacccttctacattagcctcctctgcattatcttctctatctcctcctattaatcaaagagctacgttctcttcttcagagaaatgtttccatcctt

SEQ ID NO: 156009 - DNA, 703 bp, Homo sapiens
  Payload ID: 10633
  Gene Symbol: MLIP
  Gene Name: muscular LMNA-interacting protein
  ENST ID: ENST00000511678
  CDS Start-End: 335-703
cttatagattgccagcctgctcagcgtctctaacccttttcaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagttaacttcttctcccactacctctgagcagcttgcctgtaaaccacctgctttctcctttgtttctccaactaatccgaacacaccacccgacccagttaacctcgaggga

SEQ ID NO: 156010 - DNA, 1032 bp, Homo sapiens
  Payload ID: 10633
  Gene Symbol: MLIP
  Gene Name: muscular LMNA-interacting protein
  ENST ID: ENST00000509997
  CDS Start-End: 30-710
tctttctctctttctcattctctttcaatatggaacttgaaaagcgtgaaaaaagaagcttattaaacaagaatttagaggagaaactgacgtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagactcctacaactcttccaagagcagctggtcgagaaaccaaatatgcaaatctctcctcaccatcttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaata

SEQ ID NO: 156011 - DNA, 2023 bp, Homo sapiens
  Payload ID: 10634
  Gene Symbol: MSC
  Gene Name: musculin
  Uniprot ID: O60682
  ENST ID: ENST00000325509
  CDS Start-End: 291-911
tttgttccaaggagtacagatagccttttcaaaaggcgcagcttaccgcggtgcgcgcggattctggacttgggcgccaactcgtagtccacgctccccggggtcagcagaggggcgctcacgctctcgccacccacctcgctttctcaccccgcgcttcccggcctgggtttttagtcttccttggagcgctctctggcctccgcctccgccagggagcggaaggcggagacagcgagactggccaggggggaggaaagaggacgcgtgtgggcaagggggacaacgggatgtccacgggctcggtgagtgatccggaggagatggagcttcgggggctgcagcgggagtacccggtccccgcctccaagaggccgcccctccgcggcgtagagcgcagctacgcctcgcccagtgacaactcgtcggcagaggaggaggaccccgacggcgaggaggagcgctgcgctctgggcacagccggcagcgcggaaggctgcaagaggaagcggccccgtgtggctgggggcggcggcgcaggtggtagcgcgggcggtggtggcaagaagcccctcccggccaagggctcagccgcagagtgcaagcagtcgcagcggaacgcggccaacgcccgtgagcgtgcccggatgcgcgtgctgagcaaagccttctccaggctcaagaccagcctgccctgggtgccccccgacactaagctctccaagctggacacgctccggctggcttccagttacatcgctcacctgcggcagctgttgcaggaggaccgctatgagaacggctacgtgcacccagtgaacctgacatggccattcgtggtctcgggaagaccggactctgacaccaaagaagtttccgcagccaacagactatgtggaaccaccgcttaaatcggactggaactcacttgatgggattattcgttaaatgcgagtgtttgggggccacggagagaagggagagctcgtgagatgggaagaagtttccgctggattctccttgacccttcccctttccctggaactgtgatcgtgacaggtggcgggtgtggctgtcactgcacagcgcccacggctacagctgcgccggatctgggcgaccacgttttgcctctccaaaaagagcttcctttcgtgacgagacgcggacgcaggtccaccctcgggccctagctctgtagactaactctcggctgctgccccagcccgcgccagacagcccacggatccgttctcagcggagccagattcatcgcacacgtgcgggacggttccacacagccccggcctttcgcggtgacacaatggttagggaacggttagaacgcgctctacatccgctttaaagacagaggtctagacgtgagatccgcgtcgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttcaatcccgtctccttcccaagctcccggctttttctaatcaggcaggcgtctgtcaaccctctccacttctgggctgaagcctccccaagccccgctgcgccaacctgtgtggggtcttcttcgggcctccctctccgccccgctcctgctcctacctgcagcacccccagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtgtgccccttgga

SEQ ID NO: 156012 - DNA, 721 bp, Homo sapiens
  Payload ID: 10635
  Gene Symbol: MUSTN1
  Gene Name: musculoskeletal, embryonic nuclear protein 1
  Uniprot ID: Q8IVN3
  ENST ID: ENST00000446157
  CDS Start-End: 272-520
gggtctctgcagccatctgctttcatcagggctgcagcccccaggcagcagtactgggagcccctctcatctccgagaataaactctgaagccagcgaccctgcggacctgaatcatcagggagcctgtcagaggaggggcagtgactctgcgggacaagcaagcaggctatataagtttcagaaggctgggctccactcagatcttttccagcagctgctgcctgccagagaggcgccttcagagacccagcgcttacacaatacccaccatgtcccaggctggtgctcaggaagcccctatcaagaagaagcgcccccctgtgaaggacgaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagcctttcccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagc

SEQ ID NO: 156013 - DNA, 622 bp, Homo sapiens
  Payload ID: 10635
  Gene Symbol: MUSTN1
  Gene Name: musculoskeletal, embryonic nuclear protein 1
  ENST ID: ENST00000486659
  CDS Start-End: 149-412
gttgatgccagagggagtggaggtggagtcctggacactttcggctctggcagctgtgtcttgatctgagccccaagcatgaactggaggctctgcagcccttgggagatgggggctcagggaggaccccctgaagaacccctcttctatgtggctttggtggtattccacggctggtgctcaggaagcccctatcaagaagaagcgcccccctgtgaaggacgaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagcctttcccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaatcagaag

SEQ ID NO: 156014 - DNA, 11156 bp, Homo sapiens
  Payload ID: 10636
  Gene Symbol: MKLN1
  Gene Name: muskelin 1, intracellular mediator containing kelch motifs
  Uniprot ID: Q9UL63
  ENST ID: ENST00000352689
  CDS Start-End: 41-2248
gctgccagcggtcggtggcggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagagtttcagctcctggcatcagctctattcaaatctggttcagattttacagctctgggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagttaaatatatatatatatatattttttcttactttatcttttaagaattaatgagtataaaagaaaaattaggcagtttacccttttcagatttttatttcttttttttttaattgggggaaataagcactattaacagattcagcactacaagtattttgaatgttgttgctgttggtcatttggcctgccttttcccttcctatttcactttgcctcccatcacacaactgcgtgtaaatggtgtcacttgttcacctctttacttcattcttaacaagtgtatagttctctaggacagttgatgtatgttaaggtgatatctgtgtctgtattgacttgtcttgtgttacattaaacagtaggcagaactgaggtctcaagtttgcactcttggccatagaactaaaaatgaaacctgagattgacccaagcacctatctgagattggtatataatatttctataatgatatattttatagtagatattacaatagcatctgactttgagtcacagaaaccttaaactgaggagacaatagttcagaacctttttaagagccattctaaaagtgaccagcaggagggatctagtagtgaataatatcttaatagcaattttaggagaaaatgactctttcgtccagaagagctctgcagaaccagggctcccgtttatcttgtgctatctctgtagtattttcatttgagagaggaggctgagtttccagagctttgctttcatttatttttatacacattgtctctctatatctgcttgtggatattgttattttgaagagaaatggtttgtggttgtccagtggtatacaactgacaggcatttcattaagcacatagaccagactttgtgaatggttcagatattttttcattaaaaaacaaggtatggcagatggacttttccatgggtcaaattttttgtgtgagagatagaggtacatgtcttctgatgatgtgctgtggaatgcaatgtgggaaacctacatctggctagtgcttacatttgctcaaaaagcatgttgtatgaagctgactgccaccatgctaaagcagattcatattaagaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgttatttggaggaaactaagttcttgacctcagtaattttatttttgtttttccctaaatgtttccctactagtctttttggaaaacatgtttgttttaatttcatcttccctcactttatttaggtagaatttttcccccttcatttctgaaattttttgctcaccgccatgtttaaatggggttgaatcatagcgagccatttgctcttgccaaagtgagatagatgtactgaggagataattgaaaagtcagactctgtactgtggggctttaatcggagcactgctggaaatgattgcagagaatgtagtgcttcatatatccatgaccaagattgacatgttgctcacaacatgtcacaatttagtgaggagctacatgtatttccaagaattccagcatagattataatttaaataatcgaatttggtatttaggtacattgtttatatagccaagtgtatatgctttactacctaacaattattctagcctaggtgaatccctaattgaaacacctggctaacactttagacacataaattaagtgggatacagttttctcatttgtattatctccagcttcaacctcatttatcctttttcctagtataatacattgttttcaaccagaaattaaagtagatatccaacattattttcagtgcttgtacttcatgagaaataatctgattttcaagacacctcttaagtgcatttgcattttattttggtaatggcagagacctcatgtggccagtttgattgattgaagaatgtatcactcttattcaagcaaaggaattcagacttaaatgcctacctctgtgctgaagctgacagacagtattaactcttatcaaggccatcttttagacctgattttcatttatatgaaaacagacctgtccatgtctaataagtaaaaactgatagaatacattaaaaagtcactggtttatcatagaaaagtttgatgggtttagagctcagtgatttaagcttgtaaaactgcattcttgggcaaaatatttatattgtatataaatggttggcagcttattccagttgatctcttcacatctgccttaaaagtgctatgtagagatacattaacagagttataataaaacagtgttttaaaatctagcctataaacaaaaactagtttgaggcacccaagcatttagtgagagattgagaatgatgcttaatggatcaaaaaagcaattaggagtatgttcctgattttattctctaaattatactcaatttcatggtaattacatgaagaagttacctgcaattattcttaacactacatggaattcactgggtaattgtgggtcatttatttcctgaaagtcacgtgaaatccttagctggttgaatgttgcacagtatttgagaattacggtttgaagtgatttctgtgggagggaatcattgcaatgtatattctaaataaagtcatctaactattaaaaaaaaaacacccttcctaacccttcttttcttaaaattccacattcatccacaatctcatccctttgtagaaattcttgcctgaattctcaccaagttttgaattcctaaggtagccccgatctaggatgtgaaggctgcccagaaaaagtttatggctggaggagtatcatacagtgtctacatatgatagtacttacagattaggtctttggatgctttaacacaaaagatttttgttatccttattagtcaaataacgctattcttttgtggttctagaccctggcttctatctccctgtgatttgttttaatgctgaaatgacttggctatccaaagcttctagtctagaggtctgttggttgaaggcagacatttccaagtttgttgaaataatacgaagctgactagcttacgtgaatgatgttgccctcatttgttttgggtgaggactcattactgcagtatattgatctcttcaccaaatgctttttctttttctgaataaatgctgtattagaggttctatttatatatgatttttaaaactttggtttccttctatccaccaaatactgtgaattgtttttccatttatttttcttagctaatgtaactttattcttcacttttttttagccctagacttcctagattttctgtggcattctgtaggacattgtattgcttggaaaaaaaaagatcaaaatcattctggggcaaatgctctattatccttatttatgacaagagaataatgaaattcataagaaattaataacattcagatattgctataaatgtacttgagtcattttcatttggggatagtaataatggctgtggcagctttaatggagaaacctgtgttggcctctttttctggcattaggatctcttgtcatagaactattggtaaagtacaggtttgatagcagagttcctgaattcagcatatcatcagaatttccatttaccttttgtcttttctttttattgtattttttaacctttttgtttctattcctacctcccatgagtaacattgatttctgctgaagttagaatttgtgttaagaattgactttaaacttctgaaatagttgaatattagaagtggcttcagttgccatgaaatgattgcttttctttttctttttttttccttaaataaaaataatgcagccttatatatgtctcttcccctcaagaatgtgaatttaggctgggcatagtgactcacgcctgtaatcccagacctttgggaggctgacacgggaagattgcttgagcccaggaatttcagaccagcctgggcaacacaggaagactccatctctacttaaaatatttttgttttttagccaggtgtggtggtatgtgcctgtagtcccagctacttgggaggctgaggtgggaggatcacttgaacccaggagtttggggtgcagtgagctatgattgcgacactgcactccagcctgggcaacagagcaagaccctgtctcaaaaaaaaaaaaaaaaaaagaatgtgaatttagctccaattccaaatgactaactcttaggccagtcatagccaatgaaatcatctgacggtagcttctgtagcccttaacctaaggagtcattagaggttatagtaaattagtttctctagtggtgcagagagaaatgccatcggggaaattatcactgtctttttggctaaagttttatattgtgaactggatcccacttaacagcttaaaaacacaaaaatgaaagggtagtcctagtttatcttcttaattagaatcattatttggaaataagatttgcaatgtgctgtctatccccaaacactgctgagcttgctggaaaacagaatttaacatgaatgttgtctgaaagctgtaggatcaatggcaaaaaaggggaaatgtttggtagggaattggaccagttctaaggtatcacttttaattataaaataatgtcttcctttttatctgcttttcagacagcctcagtgaactattaaacatttgtgtgcaaagtcctattttgcttatctaaggcattttgacttggaagtattaaacttcaggaacgagctagagaagacaatgagggtatgttagagaaggaaaaataggagctttttgcttatggattttagaggtccacaaatcgaaaggaaaaataaatttcttcatttctaaccctaaaataattttgttaatgagatgctgggaagaagactaccaaaaggcctcaaagctcatgcttctagaatattcagtaattctgaatagtctttgggaagtagcatttcttgggaagtagcatttcccttcttccaaataactgtttgagatcttaaaacagaaaatccagtgttaatgggctctagatcttaaactaggtgagcagcttcttacatacaaccagttccttgttaaggatccagcaggaaaaccagccataaaacatttcaacatgcagtttgggggctcccttgcttattcactgagtttaagctcttgctgcaacatagctctgtaccatctgggatgctagcagtcacagcagttagctcagatatctgagctgtctgccacacaaagcctgaggagatcatcattcttcagtttcattcattacttaatgaatgccaaattaattggcaggaagaagaaacactgtgtgatatactgaacaagcctgtgtgcatgaataaggagccactcaaaaagccaattttgagctttatttctccgttgttaacaaatctcaagaaagcctttgttacagtttagctcatgtcatttggttggttttattttctagccctttaacataggaggaaaattgtcatttcatgtataacttgtaacacagaattgaactgatactagtttccttgccttaaattaattatatgtcatcccaagggtctctgttaattctgctttgccaagcaataatgagatctgggtttggcattagaagtatttcataattttggttttttatttaggtttcctccacatctgtaaagtgattgattaaattagaggaggcgtgtagaataaatcccaatcccattgcaactggcagagctttataaatctttataaattcagttacaacaaaggagaggatcctacaccattagagccatgccatcaggtgtttgcaagtgacagctgtagtgtgttgcctcaaataataccaagttataaataataccaagtaattatcaactcactcccaaatttaataagatatcaaagtccaaaaggttacttaggagtagtcttccgtgggggaagataaatttattaaagagtcatgtactgatctttttcttgggattttttttcctttcccagaaaaaaaaattattttggtgactgatcaattgtaaacaattttcttccttacttacaaatcatccgttcagaaaaataaaagtggacttcctttcctaagcattacaattagcctgggcaagaggtgttatgattgtcttattctttaagccggcttactttttggatttgtgtgaaatgtcttttgaaaagaaagtagatagtatagtattaattaactactttgtatagtcttctgcataatttagagttgaaaataatgtaacattttcctgtgaacagattcctttatgcgtacatactttataaatatacatacatacacatacacatacatttttaaaatgctctttttaaagagattcttatcttgctcccactccaaaagctatgtacagttgagttattagcctcagaggaagagtacaggaaagcgaagatgaggacctccttttcttgtgttggtcttgggaacaaacagtattccgtctttcaaatatggcatatttctaaacagtttgggaaagatgttagaattttttaaaagtcagctcttttataaattggaagtactcagtagtcagaaattaagatcccctctgatagagatagattctcaaaaccaaaattggactgaaaattagattgagaagaaagatacaacttcctccatagccaataaaatctgtctttccaagtctgcttattaatgctgtgaatcgctccttctgtttgtgaaaacatctcctggactggaaatgtggtgctgtaaccagctgagccgaaagttggagaatgttaaatatcttatatgggacttacgataaaatgtattgatgttagtgattgtcaaaataggtttatcatttaaaaaactaggaaattactaagtataaagaagaaaaaccagtattaattaagtgatgagacctgttcattttgttttccctgacttatttccattaccaaacatagtaaaggccagaaaagattaaaaaaaaaattaacacagccattccattgttttttaccacatggagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccattatgggcatatggagcatattcataccatgaggaggagtctttgtttatgatggactttttaatatggccataattaaactcacactcaaaaaggatgagctattgtcaaaagccaaaagaaaaacagacaaaatgaacatgaagcaaggagtccataaaacaagagttctttaccacgtttaagcaaatgtctctcaaaaaaaattgtatttctgtgcacattagctgagattcacacattttgcacctcagtagtatttcagatgagactcaatgtgtggagaaaaccgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattgttgggctctgtcgtgttctgcaatcttccccattcccctcatgatctctggcttatcttttatccaatctgtatggactttttaggattttttttttcttatagtacaaataattttcagatcccagctttggtaaatgtgttaattctactttgtgaataaataaatgagtgatctgctaaaaatggcaattgtagaattatgttgtatgtaatgtacatatggagaaagaatgtattttgttcattttcttaataaaatgttatatatggatgctacaag

SEQ ID NO: 156015 - DNA, 864 bp, Homo sapiens
  Payload ID: 10636
  Gene Symbol: MKLN1
  Gene Name: muskelin 1, intracellular mediator containing kelch motifs
  ENST ID: ENST00000416992
  CDS Start-End: 487-864
tcctccagagccgcccgggagcagggagggctccgctagcccggggggccctccccgcggggcagatgagttccatatccagactctcaaaccatgttttgggatcatccaaacattccatcctcctgactccataaactattggattcataacctgctccatgcttgaaaacatggggattggaattcgtttctggcgcagaaatgtttcttgatgaatgttctgaaaagaataaagtatctcctggagtcctccactgtcgtcagccctgtacaaggcaccttggtaaacccacaggatgaacaaggaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttg

SEQ ID NO: 156016 - DNA, 2460 bp, Homo sapiens
  Payload ID: 10636
  Gene Symbol: MKLN1
  Gene Name: muskelin 1, intracellular mediator containing kelch motifs
  ENST ID: ENST00000421797
  CDS Start-End: 413-2344
aacctgatcctccggtagcgaagggctagaggcaaacaccgagctcctccagagccgcccgggagcagggagggctccgctagcccggggggccctccccgcggggcagatgagttccatatccagactctcaaaccatgttttgggatcatccaaacattccatcctcctgactccataaactattggattcataacctgctccatgcttgaaaacatggggattggaattcggaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagagtttcagctcctggcatcagctctattcaaatctggttcagattttacagctctgggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctg

SEQ ID NO: 156017 - DNA, 572 bp, Homo sapiens
  Payload ID: 10636
  Gene Symbol: MKLN1
  Gene Name: muskelin 1, intracellular mediator containing kelch motifs
  ENST ID: ENST00000429546
  CDS Start-End: 219-455
agaagctgcagggtgaggatggggaaccgtttgctccttggaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtagtaccgtgaacaggaagctattcgcctttgcctaaaacacttcagacaacacaactatacagaagcttttgagtcactgcaaaagaaaaccaagattgcactggaacatcccatgtta

SEQ ID NO: 156018 - DNA, 2448 bp, Homo sapiens
  Payload ID: 10636
  Gene Symbol: MKLN1
  Gene Name: muskelin 1, intracellular mediator containing kelch motifs
  ENST ID: ENST00000458153
  CDS Start-End: 4-516
aagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagagtttcagctcctggcatcagctctattcaaatctggttcagattttacagctctgggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagtt

SEQ ID NO: 156019 - DNA, 551 bp, Homo sapiens
  Payload ID: 10636
  Gene Symbol: MKLN1
  Gene Name: muskelin 1, intracellular mediator containing kelch motifs
  ENST ID: ENST00000446815
  CDS Start-End: 261-551
ccctcctcccgttcgctgccagcggtcggtggcggccgctacggtgctgacaagatggcggctggcggagctgtcgctgcggcgcccgagtgccggcttctcccctacgcgctacacaagtggagctccttttcctccacctaccttcccgatacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactat

SEQ ID NO: 156020 - DNA, 8257 bp, Homo sapiens
  Payload ID: 10637
  Gene Symbol: MCC
  Gene Name: mutated in colorectal cancers
  Uniprot ID: P23508
  ENST ID: ENST00000302475
  CDS Start-End: 565-3054
agaaaccacttacaactccagacgattcgaaggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggagtgtgctgatgctgcctccccagctctgtccctagccgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggcgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcatttggtcaaagttagttcctgtgattttttttttttttttttgagatggagttttgctcgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttctctgagaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactaaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtctttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcatccatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaaaatagctactttgcgttatttgatatagaattgttttttaaaaactccatttatttatacagagacatttataatattttacaaacattcttatattctgaataaatatttctaattccacagtgta

SEQ ID NO: 156021 - DNA, 3476 bp, Homo sapiens
  Payload ID: 10637
  Gene Symbol: MCC
  Gene Name: mutated in colorectal cancers
  Uniprot ID: P23508
  ENST ID: ENST00000408903
  CDS Start-End: 417-3476
atgactccgggcggtcggagaaggtctgccgggagtacacctgccctctgcctgaagcgtccccaagtgtcccgggcccgcgtcgttgccggatgcacaatgctgacacccttcccgggggcttccagtgtattctgcctcctcttgtgttcccgttgccacccttagctccctgactcttccagccaccttcccctcctccctcttccctgaggtgcctcctcgggcgattccagagcgcccatcttcccagtccgggcaaaacccggagaggtggaatccctcgcccggagcgccccggcggccactgggcatgctccgttgtcaggcaagttcggggctgcaggcagcttgcgcgccgcgcggattccagctgcggtcgcgcgtactcctcctcccaagtagggagcgggcgcatgatggcggccgcggcggcagcggctgcggggagctccagcagcggcggcggcggcggcggcagcggcagcagcagcagcagcagcgacacgtccagcaccggcgaggaggagaggatgcggcgcctcttccagacgtgcgacggcgacggggacggatacatcagcagaaatgacttgctaatggtctgtcgccagctgaatatggaagagtctgtggctgagatcatgaaccagttgggagcagatgaaaatgggaagatttcctttcaggatttcacaagatgccgcatgcagcttgttcgagaaattaggaaggaggaagtagatctttctgcaaagtcagacaactcctgtacaaagaagctgagggatagaattgcttcctggcccacgagcagtgacaacagtttgggtgccttatcagcagccagggagagctgggaatacgactctggtgccagggacctccagagcccggatgtgcagagccagtcagccctccagaagctgctcgagtatggcggaagctctttgcatcagcaggctgctctccacaaactgctcacacagtccccgcacattggcaactctgtaggaggaagctatctagagctggccaacacactccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggagtgtgctgatgctgcctccccagctctgtccctagccgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaa

SEQ ID NO: 156022 - DNA, 3844 bp, Homo sapiens
  Payload ID: 10637
  Gene Symbol: MCC
  Gene Name: mutated in colorectal cancers
  ENST ID: ENST00000515367
  CDS Start-End: 374-2674
ttttctatatataatatctgcactcaacagatattctctgtttttctgtatttttaaagggaaattggaaactatgggtagagatagagacctcttttgagggatttgggtttagtaaaaagcccgtctaggggggcttccctggcatgctgaagcataggaagatgctgcagtgtgctcctctactgtgatctgatgcagagttgccacttctagtcacactccacaaaggaagaatgtgctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggagtgtgctgatgctgcctccccagctctgtccctagccgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggcgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgct

SEQ ID NO: 156023 - DNA, 2855 bp, Homo sapiens
  Payload ID: 10637
  Gene Symbol: MCC
  Gene Name: mutated in colorectal cancers
  ENST ID: ENST00000514701
  CDS Start-End: 554-2701
acaactccagacgattcgaaggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggtagggccggagtggcttggggacacccttaggctcagtgactgcccagtgactgcccagtgaccactggccacacctcaccgccctgctgcctcagttcttgtatttgcataggaaatgcaggccattcgtaggtatctaagaaggtgacattttgagtgtaatgaaaccaggtctacattttagaaataccaaatctcactttatgtaatagttg

SEQ ID NO: 156024 - DNA, 664 bp, Homo sapiens
  Payload ID: 10637
  Gene Symbol: MCC
  Gene Name: mutated in colorectal cancers
  ENST ID: ENST00000624689
  CDS Start-End: 1-508
cgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggtgatatgatccaaaatcccccatagatgcctgaaaccacaggtaatactgaacccttatatattctacgttttcccctatacatacatacctgtgttgaagtttaatttataaattaggcacagtaaaagattaacaactaataaaatattaatagaacaatta

SEQ ID NO: 156025 - DNA, 2752 bp, Homo sapiens
  Payload ID: 10638
  Gene Symbol: MLH1
  Gene Name: mutL homolog 1
  Uniprot ID: P40692
  ENST ID: ENST00000231790
  CDS Start-End: 217-2487
gccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataatttcttatttaattttattatgtatatattgtgtcagttcagatgccaaaaagaggtcttgaacatgtcaca

SEQ ID NO: 156026 - DNA, 558 bp, Homo sapiens
  Payload ID: 10638
  Gene Symbol: MLH1
  Gene Name: mutL homolog 1
  ENST ID: ENST00000442249
  CDS Start-End: 16-132
tcttctggcgccaaaatgtcgttcgtggcaggggttattcggcggctggacgagacagtggtgaaccgcatcgcggcgggggaagttatccagcggccagctaatgctatcaaagagatgattgagaactgaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaa

SEQ ID NO: 156027 - DNA, 570 bp, Homo sapiens
  Payload ID: 10638
  Gene Symbol: MLH1
  Gene Name: mutL homolog 1
  ENST ID: ENST00000454028
  CDS Start-End: 15-131
cttctggcgccaaaatgtcgttcgtggcaggggttattcggcggctggacgagacagtggtgaaccgcatcgcggcgggggaagttatccagcggccagctaatgctatcaaagagatgattgagaactgatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcagg

SEQ ID NO: 156028 - DNA, 233 bp, Homo sapiens
  Payload ID: 10638
  Gene Symbol: MLH1
  Gene Name: mutL homolog 1
  ENST ID: ENST00000450420
  CDS Start-End: 1-186
gagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggagtgaagtgcctggctccattccaaactcctggaagtggactgtggaacaca

SEQ ID NO: 156029 - DNA, 2296 bp, Homo sapiens
  Payload ID: 10638
  Gene Symbol: MLH1
  Gene Name: mutL homolog 1
  Uniprot ID: P40692
  ENST ID: ENST00000455445
  CDS Start-End: 696-2243
ttccctgacgtgccagtcaggccttctccttttccgcagaccgtgtgtttctttaccgctctcccccgagaccttttaagggttgtttggagtatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgata

SEQ ID NO: 156030 - DNA, 917 bp, Homo sapiens
  Payload ID: 10638
  Gene Symbol: MLH1
  Gene Name: mutL homolog 1
  ENST ID: ENST00000441265
  CDS Start-End: 603-917
gacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccag

SEQ ID NO: 156031 - DNA, 608 bp, Homo sapiens
  Payload ID: 10638
  Gene Symbol: MLH1
  Gene Name: mutL homolog 1
  ENST ID: ENST00000447829
  CDS Start-End: 1-176
tacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaacctttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtgg

SEQ ID NO: 156032 - DNA, 684 bp, Homo sapiens
  Payload ID: 10638
  Gene Symbol: MLH1
  Gene Name: mutL homolog 1
  ENST ID: ENST00000413212
  CDS Start-End: 1-157
agaactgatagaaattggatgtgaggataaaaccctagccttcaaaatgaatggttacatatccaatgcaaactactcagtgaagaagtgcatcttcttactcttcatcaaccactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctc

SEQ ID NO: 156033 - DNA, 2428 bp, Homo sapiens
  Payload ID: 10638
  Gene Symbol: MLH1
  Gene Name: mutL homolog 1
  Uniprot ID: P40692
  ENST ID: ENST00000435176
  CDS Start-End: 261-2237
gacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacat

SEQ ID NO: 156034 - DNA, 2608 bp, Homo sapiens
  Payload ID: 10638
  Gene Symbol: MLH1
  Gene Name: mutL homolog 1
  Uniprot ID: P40692
  ENST ID: ENST00000458205
  CDS Start-End: 868-2415
cacaacggcggaggccgccgggttccctgacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaacaatatacgcaaagactattaaatggaagcatacctgacatgttaaaggactatcaaggaggccagtttgtctagaggctgaaaaggaaagagtaataggagatgaggtctgagtgaaaacacgtaaatccttgtgggccaagaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 156035 - DNA, 562 bp, Homo sapiens
  Payload ID: 10638
  Gene Symbol: MLH1
  Gene Name: mutL homolog 1
  ENST ID: ENST00000429117
  CDS Start-End: 313-562
cttttccgcagaccgtgtgtttctttaccgctctcccccgagaccttttaagggttgtttggagtacggagtctcactttgtcacccaggctggagtgcagtggcgcgatctcagctgactgcaacctcctcctcacagtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggca

SEQ ID NO: 156036 - DNA, 668 bp, Homo sapiens
  Payload ID: 10638
  Gene Symbol: MLH1
  Gene Name: mutL homolog 1
  ENST ID: ENST00000457004
  CDS Start-End: 33-149
ctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgatgcaaaatccacaagtattcaagtgattgttaaagagggaggcctgaagttgattcagatccaagacaatggcaccgggatcagggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatc

SEQ ID NO: 156037 - DNA, 660 bp, Homo sapiens
  Payload ID: 10638
  Gene Symbol: MLH1
  Gene Name: mutL homolog 1
  ENST ID: ENST00000458009
  CDS Start-End: 1-286
tggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgact

SEQ ID NO: 156038 - DNA, 342 bp, Homo sapiens
  Payload ID: 10638
  Gene Symbol: MLH1
  Gene Name: mutL homolog 1
  ENST ID: ENST00000413740
  CDS Start-End: 1-342
gagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagagtgaagtgcctggctccattccaaactcctggaagtggactgtggaacaca

SEQ ID NO: 156039 - DNA, 2230 bp, Homo sapiens
  Payload ID: 10638
  Gene Symbol: MLH1
  Gene Name: mutL homolog 1
  ENST ID: ENST00000456676
  CDS Start-End: 1-2039
ggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacat

SEQ ID NO: 156040 - DNA, 928 bp, Homo sapiens
  Payload ID: 10638
  Gene Symbol: MLH1
  Gene Name: mutL homolog 1
  ENST ID: ENST00000432299
  CDS Start-End: 25-171
ttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcg

SEQ ID NO: 156041 - DNA, 2366 bp, Homo sapiens
  Payload ID: 10638
  Gene Symbol: MLH1
  Gene Name: mutL homolog 1
  Uniprot ID: P40692
  ENST ID: ENST00000539477
  CDS Start-End: 630-2177
acaacggcggaggccgccgggttccctgacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaac

SEQ ID NO: 156042 - DNA, 2567 bp, Homo sapiens
  Payload ID: 10638
  Gene Symbol: MLH1
  Gene Name: mutL homolog 1
  Uniprot ID: P40692
  ENST ID: ENST00000536378
  CDS Start-End: 831-2378
gaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaac

SEQ ID NO: 156043 - DNA, 721 bp, Homo sapiens
  Payload ID: 10638
  Gene Symbol: MLH1
  Gene Name: mutL homolog 1
  ENST ID: ENST00000616768
  CDS Start-End: 1-670
tgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgtgacagccattcttatacttctgttgtattcttcaaataaaatttccagccggg

SEQ ID NO: 156044 - DNA, 7896 bp, Homo sapiens
  Payload ID: 10639
  Gene Symbol: MLH3
  Gene Name: mutL homolog 3
  Uniprot ID: Q9UHC1
  ENST ID: ENST00000355774
  CDS Start-End: 217-4578
aacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttc

SEQ ID NO: 156045 - DNA, 7819 bp, Homo sapiens
  Payload ID: 10639
  Gene Symbol: MLH3
  Gene Name: mutL homolog 3
  Uniprot ID: Q9UHC1
  ENST ID: ENST00000380968
  CDS Start-End: 217-4506
aacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcagattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttccttttt

SEQ ID NO: 156046 - DNA, 1120 bp, Homo sapiens
  Payload ID: 10639
  Gene Symbol: MLH3
  Gene Name: mutL homolog 3
  ENST ID: ENST00000555144
  CDS Start-End: 1-598
aatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttctccagcaagtagataacaagtttattgcctgtttgatgagcactaagactgaagagaatggcgaggcagctgagttgatgatgttgcaggacccgtgttgcaggcagagcagagaggatgaaaatcatgagttcagtctttgaaatgctccagaagagatgtcaaggtggccaggcacggtggctcacgcctgtaatcccagcactttgggaggccgaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccat

SEQ ID NO: 156047 - DNA, 825 bp, Homo sapiens
  Payload ID: 10639
  Gene Symbol: MLH3
  Gene Name: mutL homolog 3
  ENST ID: ENST00000554697
  CDS Start-End: 1-375
gaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggcc

SEQ ID NO: 156048 - DNA, 583 bp, Homo sapiens
  Payload ID: 10639
  Gene Symbol: MLH3
  Gene Name: mutL homolog 3
  ENST ID: ENST00000557648
  CDS Start-End: 265-583
gtgggcacgcacgagcctcaagatccaagttgctgccggctgcttagtgcattagcttagaaagcagcagaaattctgcagttaagagccctgatttgtcccgagtttggaaaaccggccccaccgcctgcaggggcccacccacgtggctctcactgatggagaagaaggggagacctttaatggcactggaatcttagggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctg

SEQ ID NO: 156049 - DNA, 2118 bp, Homo sapiens
  Payload ID: 10639
  Gene Symbol: MLH3
  Gene Name: mutL homolog 3
  ENST ID: ENST00000553713
  CDS Start-End: 1-1433
ataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactga

SEQ ID NO: 156050 - DNA, 616 bp, Homo sapiens
  Payload ID: 10639
  Gene Symbol: MLH3
  Gene Name: mutL homolog 3
  ENST ID: ENST00000553263
  CDS Start-End: 130-616
ctcgcggcctggcgcgccccctccgaagcgcatgctcgtgggcacgcacgagcctcaagatccaaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatgg

SEQ ID NO: 156051 - DNA, 4229 bp, Homo sapiens
  Payload ID: 10639
  Gene Symbol: MLH3
  Gene Name: mutL homolog 3
  ENST ID: ENST00000556257
  CDS Start-End: 107-3934
acgagcctcaagatccaaggtgcgcgcgtcggcgtccgaggcggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatggttatctctttaggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagt

SEQ ID NO: 156052 - DNA, 635 bp, Homo sapiens
  Payload ID: 10639
  Gene Symbol: MLH3
  Gene Name: mutL homolog 3
  ENST ID: ENST00000556453
  CDS Start-End: 1-323
ctgaggacattcaggctgcttgtactaaagacctgacaactgtggctgtggatgttgtacttgagaatgatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcagattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatg

SEQ ID NO: 156053 - DNA, 4491 bp, Homo sapiens
  Payload ID: 10639
  Gene Symbol: MLH3
  Gene Name: mutL homolog 3
  Uniprot ID: Q9UHC1
  ENST ID: ENST00000556740
  CDS Start-End: 37-4398
ccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgac

SEQ ID NO: 156054 - DNA, 3307 bp, Homo sapiens
  Payload ID: 10640
  Gene Symbol: MSH2
  Gene Name: mutS homolog 2
  Uniprot ID: P43246
  ENST ID: ENST00000233146
  CDS Start-End: 224-3028
gcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttga

SEQ ID NO: 156055 - DNA, 3628 bp, Homo sapiens
  Payload ID: 10640
  Gene Symbol: MSH2
  Gene Name: mutS homolog 2
  ENST ID: ENST00000406134
  CDS Start-End: 63-2828
aaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagaacctcagagtgacagagccaaaagaccagtgcctcattttgctgacatggaaaaggaaacttcgtgggggaaagagatctgcttgcagtcggccagagagacagaaccagggcagtggtgagctctcatgacctggtgtctgttgccttctggttaagtttttcatttgtaattctacaaacatcccttctgtaaacatttccctcaaaatggagcaggaagctctcaaaaatggaccagaaaggggtcaggaatataactttctctgcccagattccaggacttacagtgagaaagcgccttctgggaacttcacaatggctaaagtgtgctaatgggatgatgtgcccttgtacacccactgcctctgaactctgctctgcattgctgagcaaactacatttcccagaactccttgttggattccttccaaacaggtttaccactgggagagcctgttggttggggagggcaggaagagggaggaaagaggaagggactcacttcctgtttccagctgaagtctaaatcaatccactatcaacaggtagctatcatactaccctcattgtcacccctcagaggtcccactgcagctgcataatgtcccctcagtggcctgaacatgagatgaacaacactcttcttgggagtaccagccttgcttggttcatggccacttttcctgattatcttgcagctatattaggtcatgtgacaaagttctggccagtggcaagggaacacaagtgataggtacagatagaagtgtctgatactacatagattatgcttgcactcactcttaagagagagacatgaacttttaccaacggaagccagtattattttgaacctctgttagagtggcttgaatctgtatcctaacttgtatccctaatgtgtgacccatgaaaattagccaggcagc

SEQ ID NO: 156056 - DNA, 560 bp, Homo sapiens
  Payload ID: 10640
  Gene Symbol: MSH2
  Gene Name: mutS homolog 2
  ENST ID: ENST00000454849
  CDS Start-End: 140-560
aagctgattgggtgtggtcgccgtggccggacgccgctcgggggacgtgggaggggaggcgggaaacagcttagtgggtgtggggtcgcgcattttcttcaaccaggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactg

SEQ ID NO: 156057 - DNA, 3024 bp, Homo sapiens
  Payload ID: 10640
  Gene Symbol: MSH2
  Gene Name: mutS homolog 2
  Uniprot ID: P43246
  ENST ID: ENST00000543555
  CDS Start-End: 140-2746
aagctgattgggtgtggtcgccgtggccggacgccgctcgggggacgtgggaggggaggcgggaaacagcttagtgggtgtggggtcgcgcattttcttcaaccaggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttg

SEQ ID NO: 156058 - DNA, 2917 bp, Homo sapiens
  Payload ID: 10640
  Gene Symbol: MSH2
  Gene Name: mutS homolog 2
  ENST ID: ENST00000617938
  CDS Start-End: 41-1066
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 156059 - DNA, 2918 bp, Homo sapiens
  Payload ID: 10640
  Gene Symbol: MSH2
  Gene Name: mutS homolog 2
  ENST ID: ENST00000621359
  CDS Start-End: 41-2473
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaaccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 156060 - DNA, 2918 bp, Homo sapiens
  Payload ID: 10640
  Gene Symbol: MSH2
  Gene Name: mutS homolog 2
  ENST ID: ENST00000617333
  CDS Start-End: 41-1273
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagattacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 156061 - DNA, 2917 bp, Homo sapiens
  Payload ID: 10640
  Gene Symbol: MSH2
  Gene Name: mutS homolog 2
  ENST ID: ENST00000610696
  CDS Start-End: 41-1642
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 156062 - DNA, 2917 bp, Homo sapiens
  Payload ID: 10640
  Gene Symbol: MSH2
  Gene Name: mutS homolog 2
  ENST ID: ENST00000613514
  CDS Start-End: 41-1498
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 156063 - DNA, 4092 bp, Homo sapiens
  Payload ID: 10641
  Gene Symbol: MSH3
  Gene Name: mutS homolog 3
  Uniprot ID: P20585
  ENST ID: ENST00000265081
  CDS Start-End: 81-3494
ccgcagacgcctgggaactgcggccgcgggctcgcgctcctcgccaggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggctgcagcggccgcagcggccgcagcgcccccagcgcccccagctcccgccttcccgccccagctgccgccgcacatagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacagagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcgcagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctc

SEQ ID NO: 156064 - DNA, 3266 bp, Homo sapiens
  Payload ID: 10642
  Gene Symbol: MSH4
  Gene Name: mutS homolog 4
  Uniprot ID: O15457
  ENST ID: ENST00000263187
  CDS Start-End: 105-2915
gcgcagttctcccgcccgtttcagcggcgcagcttctgtagttgggctactggaggggtcgctcagaaacctcatacttctcgggtcagggaaggtttgggaggatgctgaggcctgagatctcatcaacctcgccttctgccccggcggtttccccgtcgtcgggagaaacccgctcacctcagggtccccgctacaatttcggactccaggagactccacagagccgcccttcggtccaggtggtctctgcatccacctgtcctggcacgtcaggagctgcgggcgaccggagcagcagcagcagcagccttccctgccccgcgccaaactcccggccagctcaaggttcatactttggaaacaaaagagcttatgcagaaaacacagttgcatcaaattttacttttggtgcaagctcatcttctgcacgagatactaattatcctcaaacacttaaaactccattgtctactggaaatcctcagagatcaggttataagagctggacaccacaagtgggatattcagcttcatcctcatctgcgatttctgcacactccccatcagttattgtagctgttgtagaagggagaggacttgccagaggtgaaataggaatggcaagtattgatttaaaaaacccccaaattatactatcccagtttgcagacaacacaacatatgcaaaggtgatcactaaacttaaaattttatcacctttggaaataataatgtcaaatactgcttgtgctgtggggaattccaccaagttgttcactctgatcacagaaaatttcaagaatgttaatttcactactatccaaaggaaatacttcaatgaaacaaaaggattagagtacattgaacagttatgcatagcagaattcagcactgtcctaatggaggttcagtccaagtattactgccttgcagctgttgcagctttgttaaaatatgttgaatttattcaaaattcagtttatgcaccaaaatcactgaagatttgtttccagggtagtgaacagacagccatgatagattcatcatcagcccaaaaccttgaattgttaattaataatcaagactataggaataatcacactctctttggtgttctaaattatactaagactcctggagggagtagacgacttcgttctaatatattagagcctctagttgatattgaaaccattaacatgagattagattgtgttcaagaactacttcaagatgaggaactattttttggacttcaatcagttatatcaagatttcttgatacagagcagcttctttctgttttagtccaaattccaaagcaagacacggtcaatgctgctgaatcaaagataacaaatttaatatacttaaaacataccttggaacttgtggatcctttaaagattgctatgaagaactgtaacacacctttattaagagcttactatggttccttggaagacaagaggtttggaatcatacttgaaaagattaaaacagtaattaatgatgatgcaagatacatgaaaggatgcctaaacatgaggactcagaagtgctatgcagtgaggtctaacataaatgaatttcttgacatagcaagaagaacatacacagagattgtagatgacatagcaggaatgatatcacaacttggagaaaaatatagtctacctttaaggacaagttttagctctgctcgaggatttttcatccagatgactacagattgtatagccctacctagtgatcaacttccttcagaatttattaagatttctaaagtgaaaaattcttacagctttacatcagcagatttaattaaaatgaatgaaagatgccaagaatctttgagagaaatctatcacatgacttatatgatagtgtgcaaactgcttagtgagatttatgaacatattcattgcttatataaactatctgacactgtgtcaatgctggatatgctactgtcatttgctcatgcctgcactctttctgactatgttcgaccagaatttactgatactttagcaatcaaacagggatggcatcctattcttgaaaaaatatctgcggaaaaacctattgccaacaatacctatgttacagaagggagtaattttttgatcataactggaccaaacatgagtggaaaatccacatatttaaaacagattgctctttgtcagattatggcccagattggatcatatgttccagcagaatattcttcctttagaattgctaaacagatttttacaagaattagtactgatgatgatatcgaaacaaattcatcaacatttatgaaagaaatgaaagagatagcatatattctacataatgctaatgacaaatcgctcatattaattgatgaacttggcagaggtactaatacggaagaaggtattggcatttgttatgctgtttgtgaatatctactgagcttaaaggcatttacactgtttgctacacatttcctggaactatgccatattgatgccctgtatcctaatgtagaaaacatgcattttgaagttcaacatgtaaagaatacctcaagaaataaagaagcaattttgtatacctacaaactttctaagggactcacagaagagaaaaattatggattaaaagctgcagaggtgtcatcacttccaccatcaattgtcttggatgccaaggaaatcacaactcaaattacgagacaaattttgcaaaaccaaaggagtacccctgagatggaaagacagagagctgtgtaccatctagccactaggcttgttcaaactgctcgaaactctcaattggatccagacagtttacgaatatatttaagtaacctcaagaagaagtacaaagaagattttcccaggactgaacaagttccagaaaagactgaagaataatcacaattctaatgtaataatatatcttaattcaaggaacctagaatttatttttctccttagagataaggaaaataacatttgccaaatttcatattttaattgaaaattacattatattaacatcacaattgtcatctatatattctatatgaaaaatatttattataacttaacaaatgagaactacttaaaggaatggtttttatgttaggagaaaatacaatacaccacttttttctcacaaaaattcacattattaagacctaagttcatttatacttacaagttatagtttaaaatattattgtaaataccctagtttaataaacacctttctttttaggtctg

SEQ ID NO: 156065 - DNA, 2708 bp, Homo sapiens
  Payload ID: 10643
  Gene Symbol: MSH5
  Gene Name: mutS homolog 5
  Uniprot ID: O43196
  ENST ID: ENST00000375703
  CDS Start-End: 56-2563
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156066 - DNA, 2669 bp, Homo sapiens
  Payload ID: 10643
  Gene Symbol: MSH5
  Gene Name: mutS homolog 5
  Uniprot ID: O43196
  ENST ID: ENST00000375740
  CDS Start-End: 56-2524
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156067 - DNA, 2775 bp, Homo sapiens
  Payload ID: 10643
  Gene Symbol: MSH5
  Gene Name: mutS homolog 5
  Uniprot ID: O43196
  ENST ID: ENST00000375750
  CDS Start-End: 126-2630
ggttaggagggcggggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156068 - DNA, 3094 bp, Homo sapiens
  Payload ID: 10643
  Gene Symbol: MSH5
  Gene Name: mutS homolog 5
  Uniprot ID: O43196
  ENST ID: ENST00000375755
  CDS Start-End: 287-2791
agcggttaggagggcggggcgcgtgcgcgcgcacctcgctcacgcgccggcgcgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaacc

SEQ ID NO: 156069 - DNA, 2704 bp, Homo sapiens
  Payload ID: 10643
  Gene Symbol: MSH5
  Gene Name: mutS homolog 5
  ENST ID: ENST00000395853
  CDS Start-End: 1033-2559
gtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccgcgcccggccctgatagccgatgaggtttttttgtcattgttcttcttgtatcattacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156070 - DNA, 1639 bp, Homo sapiens
  Payload ID: 10643
  Gene Symbol: MSH5
  Gene Name: mutS homolog 5
  ENST ID: ENST00000442688
  CDS Start-End: 1-1494
actgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156071 - DNA, 616 bp, Homo sapiens
  Payload ID: 10643
  Gene Symbol: MSH5
  Gene Name: mutS homolog 5
  ENST ID: ENST00000452856
  CDS Start-End: 1-471
actgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156072 - DNA, 2669 bp, Homo sapiens; identical to SEQ ID NO: 156066
  Payload ID: 10643
  Gene Symbol: MSH5
  Gene Name: mutS homolog 5
  Uniprot ID: O43196
  ENST ID: ENST00000448617
  CDS Start-End: 56-2524

SEQ ID NO: 156073 - DNA, 694 bp, Homo sapiens
  Payload ID: 10643
  Gene Symbol: MSH5
  Gene Name: mutS homolog 5
  ENST ID: ENST00000445611
  CDS Start-End: 113-694
gcgccggcgcgctccttttgcaggctcgtggcggtcggtcagcggggcgttctcccacctgtagcgactcagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaaga

SEQ ID NO: 156074 - DNA, 2729 bp, Homo sapiens
  Payload ID: 10643
  Gene Symbol: MSH5
  Gene Name: mutS homolog 5
  Uniprot ID: O43196
  ENST ID: ENST00000427735
  CDS Start-End: 80-2584
gcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156075 - DNA, 1549 bp, Homo sapiens
  Payload ID: 10643
  Gene Symbol: MSH5
  Gene Name: mutS homolog 5
  ENST ID: ENST00000444225
  CDS Start-End: 1-1404
actgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156076 - DNA, 575 bp, Homo sapiens
  Payload ID: 10643
  Gene Symbol: MSH5
  Gene Name: mutS homolog 5
  ENST ID: ENST00000446724
  CDS Start-End: 1-348
attgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatggtaagaccctcaacctctgtaaggtgagtgatgaggaaaatgagtcagcagctgaggaagagcgttactctacagcagcactgcccaatatgggatctctcctctgtagttttactctgagctttaccagcactgagacaaaggaaagagaagtcagagttaggggctggaggtggggttagaaagatggggaaggagaggaggaccaagagatgcaaagtccacagctttgaacccctgtacccagtttctct

SEQ ID NO: 156077 - DNA, 2704 bp, Homo sapiens
  Payload ID: 10643
  Gene Symbol: MSH5
  Gene Name: mutS homolog 5
  ENST ID: ENST00000414412
  CDS Start-End: 1033-2559
gtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccgcgcccggccctgatagccaatgaggtttttttgtcattgttcttcttgtatcattacagactcatggccttttgtagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156078 - DNA, 694 bp, Homo sapiens; identical to SEQ ID NO: 156073
  Payload ID: 10643
  Gene Symbol: MSH5
  Gene Name: mutS homolog 5
  ENST ID: ENST00000422658
  CDS Start-End: 113-694

SEQ ID NO: 156079 - DNA, 405 bp, Homo sapiens
  Payload ID: 10643
  Gene Symbol: MSH5
  Gene Name: mutS homolog 5
  ENST ID: ENST00000430241
  CDS Start-End: 1-405
ggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 156080 - DNA, 2884 bp, Homo sapiens
  Payload ID: 10643
  Gene Symbol: MSH5
  Gene Name: mutS homolog 5
  Uniprot ID: O43196
  ENST ID: ENST00000456839
  CDS Start-End: 235-2739
cgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156081 - DNA, 326 bp, Homo sapiens
  Payload ID: 10643
  Gene Symbol: MSH5
  Gene Name: mutS homolog 5
  ENST ID: ENST00000432714
  CDS Start-End: 56-326
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagag

SEQ ID NO: 156082 - DNA, 2290 bp, Homo sapiens
  Payload ID: 10643
  Gene Symbol: MSH5
  Gene Name: mutS homolog 5
  ENST ID: ENST00000457917
  CDS Start-End: 56-2290
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 156083 - DNA, 2708 bp, Homo sapiens
  Payload ID: 10643
  Gene Symbol: MSH5
  Gene Name: mutS homolog 5
  Uniprot ID: O43196
  ENST ID: ENST00000419269
  CDS Start-End: 56-2563
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156084 - DNA, 1000 bp, Homo sapiens
  Payload ID: 10643
  Gene Symbol: MSH5
  Gene Name: mutS homolog 5
  ENST ID: ENST00000450148
  CDS Start-End: 1-1000
aaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtatacttatctcctcaggtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctggggg

SEQ ID NO: 156085 - DNA, 2666 bp, Homo sapiens
  Payload ID: 10643
  Gene Symbol: MSH5
  Gene Name: mutS homolog 5
  ENST ID: ENST00000436559
  CDS Start-End: 56-2521
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156086 - DNA, 891 bp, Homo sapiens
  Payload ID: 10643
  Gene Symbol: MSH5
  Gene Name: mutS homolog 5
  Uniprot ID: O43196
  ENST ID: ENST00000436091
  CDS Start-End: 80-891
gcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 156087 - DNA, 1000 bp, Homo sapiens; identical to SEQ ID NO: 156084
  Payload ID: 10643
  Gene Symbol: MSH5
  Gene Name: mutS homolog 5
  ENST ID: ENST00000443665
  CDS Start-End: 1-1000

SEQ ID NO: 156088 - DNA, 475 bp, Homo sapiens
  Payload ID: 10643
  Gene Symbol: MSH5
  Gene Name: mutS homolog 5
  ENST ID: ENST00000456436
  CDS Start-End: 1-475
actgtgtacagtgccctgggcctgagggatgcctgccgctccctgccgcagtccatccagctctttcgggacattgcccaagagttctctgatgacctgcaccatatcgccagcctcattgggaaagtatacttatctcctcaggtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctggggg

SEQ ID NO: 156089 - DNA, 323 bp, Homo sapiens
  Payload ID: 10643
  Gene Symbol: MSH5
  Gene Name: mutS homolog 5
  ENST ID: ENST00000453872
  CDS Start-End: 1-323
aaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 156090 - DNA, 2704 bp, Homo sapiens; identical to SEQ ID NO: 156069
  Payload ID: 10643
  Gene Symbol: MSH5
  Gene Name: mutS homolog 5
  ENST ID: ENST00000436004
  CDS Start-End: 1033-2559

SEQ ID NO: 156091 - DNA, 2704 bp, Homo sapiens; identical to SEQ ID NO: 156069
  Payload ID: 10643
  Gene Symbol: MSH5
  Gene Name: mutS homolog 5
  ENST ID: ENST00000430216
  CDS Start-End: 1033-2559

SEQ ID NO: 156092 - DNA, 326 bp, Homo sapiens; identical to SEQ ID NO: 156081
  Payload ID: 10643
  Gene Symbol: MSH5
  Gene Name: mutS homolog 5
  ENST ID: ENST00000416964
  CDS Start-End: 56-326

SEQ ID NO: 156093 - DNA, 694 bp, Homo sapiens; identical to SEQ ID NO: 156073
  Payload ID: 10643
  Gene Symbol: MSH5
  Gene Name: mutS homolog 5
  ENST ID: ENST00000430217
  CDS Start-End: 113-694

SEQ ID NO: 156094 - DNA, 2729 bp, Homo sapiens
  Payload ID: 10643
  Gene Symbol: MSH5
  Gene Name: mutS homolog 5
  Uniprot ID: O43196
  ENST ID: ENST00000416549
  CDS Start-End: 80-2584
gcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156095 - DNA, 545 bp, Homo sapiens
  Payload ID: 10643
  Gene Symbol: MSH5
  Gene Name: mutS homolog 5
  ENST ID: ENST00000456073
  CDS Start-End: 1-477
cacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacaatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctc

SEQ ID NO: 156096 - DNA, 867 bp, Homo sapiens
  Payload ID: 10643
  Gene Symbol: MSH5
  Gene Name: mutS homolog 5
  Uniprot ID: O43196
  ENST ID: ENST00000420731
  CDS Start-End: 56-867
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 156097 - DNA, 2704 bp, Homo sapiens; identical to SEQ ID NO: 156069
  Payload ID: 10643
  Gene Symbol: MSH5
  Gene Name: mutS homolog 5
  ENST ID: ENST00000448169
  CDS Start-End: 1033-2559

SEQ ID NO: 156098 - DNA, 2260 bp, Homo sapiens
  Payload ID: 10643
  Gene Symbol: MSH5
  Gene Name: mutS homolog 5
  ENST ID: ENST00000427968
  CDS Start-End: 80-2260
gcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 156099 - DNA, 616 bp, Homo sapiens; identical to SEQ ID NO: 156071
  Payload ID: 10643
  Gene Symbol: MSH5
  Gene Name: mutS homolog 5
  ENST ID: ENST00000427687
  CDS Start-End: 1-471

SEQ ID NO: 156100 - DNA, 1636 bp, Homo sapiens
  Payload ID: 10643
  Gene Symbol: MSH5
  Gene Name: mutS homolog 5
  ENST ID: ENST00000414810
  CDS Start-End: 1-1491
actgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156101 - DNA, 2729 bp, Homo sapiens; identical to SEQ ID NO: 156074
  Payload ID: 10643
  Gene Symbol: MSH5
  Gene Name: mutS homolog 5
  Uniprot ID: O43196
  ENST ID: ENST00000441395
  CDS Start-End: 80-2584

SEQ ID NO: 156102 - DNA, 694 bp, Homo sapiens; identical to SEQ ID NO: 156073
  Payload ID: 10643
  Gene Symbol: MSH5
  Gene Name: mutS homolog 5
  ENST ID: ENST00000425703
  CDS Start-End: 113-694

SEQ ID NO: 156103 - DNA, 694 bp, Homo sapiens; identical to SEQ ID NO: 156073
  Payload ID: 10643
  Gene Symbol: MSH5
  Gene Name: mutS homolog 5
  ENST ID: ENST00000427298
  CDS Start-End: 113-694

SEQ ID NO: 156104 - DNA, 2704 bp, Homo sapiens; identical to SEQ ID NO: 156069
  Payload ID: 10643
  Gene Symbol: MSH5
  Gene Name: mutS homolog 5
  ENST ID: ENST00000439816
  CDS Start-End: 1033-2559

SEQ ID NO: 156105 - DNA, 383 bp, Homo sapiens
  Payload ID: 10643
  Gene Symbol: MSH5
  Gene Name: mutS homolog 5
  ENST ID: ENST00000424681
  CDS Start-End: 113-383
gcgccggcgcgctccttttgcaggctcgtggcggtcggtcagcggggcgttctcccacctgtagcgactcagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagag

SEQ ID NO: 156106 - DNA, 1546 bp, Homo sapiens
  Payload ID: 10643
  Gene Symbol: MSH5
  Gene Name: mutS homolog 5
  ENST ID: ENST00000458424
  CDS Start-End: 1-1401
actgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156107 - DNA, 1000 bp, Homo sapiens; identical to SEQ ID NO: 156084
  Payload ID: 10643
  Gene Symbol: MSH5
  Gene Name: mutS homolog 5
  ENST ID: ENST00000425344
  CDS Start-End: 1-1000

SEQ ID NO: 156108 - DNA, 1046 bp, Homo sapiens
  Payload ID: 10643
  Gene Symbol: MSH5
  Gene Name: mutS homolog 5
  Uniprot ID: O43196
  ENST ID: ENST00000412070
  CDS Start-End: 235-1046
cgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 156109 - DNA, 2239 bp, Homo sapiens
  Payload ID: 10643
  Gene Symbol: MSH5
  Gene Name: mutS homolog 5
  ENST ID: ENST00000416819
  CDS Start-End: 56-2239
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 156110 - DNA, 1636 bp, Homo sapiens; identical to SEQ ID NO: 156100
  Payload ID: 10643
  Gene Symbol: MSH5
  Gene Name: mutS homolog 5
  ENST ID: ENST00000454820
  CDS Start-End: 1-1491

SEQ ID NO: 156111 - DNA, 616 bp, Homo sapiens; identical to SEQ ID NO: 156071
  Payload ID: 10643
  Gene Symbol: MSH5
  Gene Name: mutS homolog 5
  ENST ID: ENST00000447504
  CDS Start-End: 1-471

SEQ ID NO: 156112 - DNA, 2884 bp, Homo sapiens
  Payload ID: 10643
  Gene Symbol: MSH5
  Gene Name: mutS homolog 5
  Uniprot ID: O43196
  ENST ID: ENST00000441401
  CDS Start-End: 235-2739
cgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156113 - DNA, 616 bp, Homo sapiens; identical to SEQ ID NO: 156071
  Payload ID: 10643
  Gene Symbol: MSH5
  Gene Name: mutS homolog 5
  ENST ID: ENST00000412630
  CDS Start-End: 1-471

SEQ ID NO: 156114 - DNA, 2706 bp, Homo sapiens
  Payload ID: 10643
  Gene Symbol: MSH5
  Gene Name: mutS homolog 5
  ENST ID: ENST00000423982
  CDS Start-End: 242-2155
ctccgcgtgacaggaatgagggtggggcgcgtggagtttcccacaatctgtactttagttaaatacccgagaattcacctcctgtgtccacagctctccacgcccctcagccctgccccgcagccctgtagcagaagtacttagtgctttgcattctgcgcgccaccctaccccggcctcctctgtgaatcgttgcttccgaaccgccctcactttttgcatccgcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctct

SEQ ID NO: 156115 - DNA, 616 bp, Homo sapiens; identical to SEQ ID NO: 156071
  Payload ID: 10643
  Gene Symbol: MSH5
  Gene Name: mutS homolog 5
  ENST ID: ENST00000429846
  CDS Start-End: 1-471

SEQ ID NO: 156116 - DNA, 2712 bp, Homo sapiens
  Payload ID: 10643
  Gene Symbol: MSH5
  Gene Name: mutS homolog 5
  Uniprot ID: O43196
  ENST ID: ENST00000436192
  CDS Start-End: 56-2563
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagata

SEQ ID NO: 156117 - DNA, 2708 bp, Homo sapiens; identical to SEQ ID NO: 156065
  Payload ID: 10643
  Gene Symbol: MSH5
  Gene Name: mutS homolog 5
  Uniprot ID: O43196
  ENST ID: ENST00000435700
  CDS Start-End: 56-2563

SEQ ID NO: 156118 - DNA, 1000 bp, Homo sapiens; identical to SEQ ID NO: 156084
  Payload ID: 10643
  Gene Symbol: MSH5
  Gene Name: mutS homolog 5
  ENST ID: ENST00000412201
  CDS Start-End: 1-1000

SEQ ID NO: 156119 - DNA, 1636 bp, Homo sapiens; identical to SEQ ID NO: 156100
  Payload ID: 10643
  Gene Symbol: MSH5
  Gene Name: mutS homolog 5
  ENST ID: ENST00000414514
  CDS Start-End: 1-1491

SEQ ID NO: 156120 - DNA, 2884 bp, Homo sapiens; identical to SEQ ID NO: 156112
  Payload ID: 10643
  Gene Symbol: MSH5
  Gene Name: mutS homolog 5
  Uniprot ID: O43196
  ENST ID: ENST00000457742
  CDS Start-End: 235-2739

SEQ ID NO: 156121 - DNA, 2236 bp, Homo sapiens
  Payload ID: 10643
  Gene Symbol: MSH5
  Gene Name: mutS homolog 5
  ENST ID: ENST00000412975
  CDS Start-End: 1034-2236
gtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccgcgcccggccctgatagccgatgaggtttttttgtcattgttcttcttgtatcattacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaattttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 156122 - DNA, 1639 bp, Homo sapiens; identical to SEQ ID NO: 156070
  Payload ID: 10643
  Gene Symbol: MSH5
  Gene Name: mutS homolog 5
  ENST ID: ENST00000426512
  CDS Start-End: 1-1494

SEQ ID NO: 156123 - DNA, 694 bp, Homo sapiens; identical to SEQ ID NO: 156073
  Payload ID: 10643
  Gene Symbol: MSH5
  Gene Name: mutS homolog 5
  ENST ID: ENST00000443906
  CDS Start-End: 113-694

SEQ ID NO: 156124 - DNA, 1000 bp, Homo sapiens; identical to SEQ ID NO: 156084
  Payload ID: 10643
  Gene Symbol: MSH5
  Gene Name: mutS homolog 5
  ENST ID: ENST00000435942
  CDS Start-End: 1-1000

SEQ ID NO: 156125 - DNA, 475 bp, Homo sapiens; identical to SEQ ID NO: 156088
  Payload ID: 10643
  Gene Symbol: MSH5
  Gene Name: mutS homolog 5
  ENST ID: ENST00000422428
  CDS Start-End: 1-475

SEQ ID NO: 156126 - DNA, 1636 bp, Homo sapiens; identical to SEQ ID NO: 156100
  Payload ID: 10643
  Gene Symbol: MSH5
  Gene Name: mutS homolog 5
  ENST ID: ENST00000437726
  CDS Start-End: 1-1491

SEQ ID NO: 156127 - DNA, 616 bp, Homo sapiens
  Payload ID: 10643
  Gene Symbol: MSH5
  Gene Name: mutS homolog 5
  ENST ID: ENST00000457795
  CDS Start-End: 1-471
actgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156128 - DNA, 2415 bp, Homo sapiens
  Payload ID: 10643
  Gene Symbol: MSH5
  Gene Name: mutS homolog 5
  ENST ID: ENST00000458058
  CDS Start-End: 235-2415
cgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 156129 - DNA, 2666 bp, Homo sapiens
  Payload ID: 10643
  Gene Symbol: MSH5
  Gene Name: mutS homolog 5
  ENST ID: ENST00000458144
  CDS Start-End: 56-2521
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156130 - DNA, 694 bp, Homo sapiens; identical to SEQ ID NO: 156073
  Payload ID: 10643
  Gene Symbol: MSH5
  Gene Name: mutS homolog 5
  ENST ID: ENST00000420729
  CDS Start-End: 113-694

SEQ ID NO: 156131 - DNA, 195 bp, Homo sapiens
  Payload ID: 10643
  Gene Symbol: MSH5
  Gene Name: mutS homolog 5
  ENST ID: ENST00000445511
  CDS Start-End: 1-195
actgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 156132 - DNA, 918 bp, Homo sapiens
  Payload ID: 10643
  Gene Symbol: MSH5
  Gene Name: mutS homolog 5
  ENST ID: ENST00000443040
  CDS Start-End: 56-918
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 156133 - DNA, 764 bp, Homo sapiens
  Payload ID: 10643
  Gene Symbol: MSH5
  Gene Name: mutS homolog 5
  ENST ID: ENST00000497269
  CDS Start-End: 1-130
aagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaaggtaaggccttccttcttgaatcccaaaagtccaggtaaaggccctcagcctgtattccagactgtctgtaccctagacatgctgtccaattttattctaccctcttttttttttttttggagacagcctcgctctgtcgcccaggctgaagtgccatggggcgatcttggctcactgcaacctccgcctcctgggttcaagcaattctgcctcagcctcccgagaagttgggattacaagcgcccgccaccatgcctggcaaatttttgtatttttagtagagacaggatttcaccatgttggccaggctggtcttgaactcctgacttcaggtgatccacctgcctcagcctcccaaggtgctgggattacaggtgtgaaccaccaggcccggcctccctcttttttttt

SEQ ID NO: 156134 - DNA, 2296 bp, Homo sapiens
  Payload ID: 10643
  Gene Symbol: MSH5
  Gene Name: mutS homolog 5
  ENST ID: ENST00000463144
  CDS Start-End: 1-478
agatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctaga

SEQ ID NO: 156135 - DNA, 857 bp, Homo sapiens
  Payload ID: 10643
  Gene Symbol: MSH5
  Gene Name: mutS homolog 5
  ENST ID: ENST00000484309
  CDS Start-End: 1-501
ggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156136 - DNA, 857 bp, Homo sapiens
  Payload ID: 10643
  Gene Symbol: MSH5
  Gene Name: mutS homolog 5
  ENST ID: ENST00000486024
  CDS Start-End: 1-501
ggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttggattggccaagggtttcaggacaggaaggaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 156137 - DNA, 277 bp, Homo sapiens
  Payload ID: 10643
  Gene Symbol: MSH5
  Gene Name: mutS homolog 5
  ENST ID: ENST00000462922
  CDS Start-End: 1-144
actgtgtacagtgccctgggcctgagggatgcctgccgctccctgccgcagtccatccagctctttcgggacattgcccaagagttctctgatgacctgcaccatatcgccagcctcattgggaaagtaaaaagcgaagactgatgggacttcccagtttccttactgaggttgcccgcaaggagctggagaatctggactcccgtattccttcatgcagtgtcatctacatccctctgattggcttccttctttctattccccgcctgccttccat

SEQ ID NO: 156138 - DNA, 857 bp, Homo sapiens; identical to SEQ ID NO: 156135
  Payload ID: 10643
  Gene Symbol: MSH5
  Gene Name: mutS homolog 5
  ENST ID: ENST00000497253
  CDS Start-End: 1-501

SEQ ID NO: 156139 - DNA, 857 bp, Homo sapiens; identical to SEQ ID NO: 156135
  Payload ID: 10643
  Gene Symbol: MSH5
  Gene Name: mutS homolog 5
  ENST ID: ENST00000492052
  CDS Start-End: 206-355

SEQ ID NO: 156140 - DNA, 857 bp, Homo sapiens; identical to SEQ ID NO: 156135
  Payload ID: 10643
  Gene Symbol: MSH5
  Gene Name: mutS homolog 5
  ENST ID: ENST00000469938
  CDS Start-End: 1-501

SEQ ID NO: 156141 - DNA, 857 bp, Homo sapiens; identical to SEQ ID NO: 156135
  Payload ID: 10643
  Gene Symbol: MSH5
  Gene Name: mutS homolog 5
  ENST ID: ENST00000471854
  CDS Start-End: 1-501

SEQ ID NO: 156142 - DNA, 326 bp, Homo sapiens; identical to SEQ ID NO: 156081
  Payload ID: 10643
  Gene Symbol: MSH5
  Gene Name: mutS homolog 5
  ENST ID: ENST00000471718
  CDS Start-End: 56-326

SEQ ID NO: 156143 - DNA, 330 bp, Homo sapiens
  Payload ID: 10643
  Gene Symbol: MSH5
  Gene Name: mutS homolog 5
  ENST ID: ENST00000480377
  CDS Start-End: 60-330
cgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagag

SEQ ID NO: 156144 - DNA, 7476 bp, Homo sapiens
  Payload ID: 10644
  Gene Symbol: MSH6
  Gene Name: mutS homolog 6
  Uniprot ID: P52701
  ENST ID: ENST00000234420
  CDS Start-End: 153-4235
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaccatttttccattttctttctaggaaattaaacccttttaattcttatctaccttctacataatggttattgaatactccacaatatattaagtctagatgttatggtacatgcatacactttcaggctgttttatacccactgtcaccaatacacataaatgggggaggaaaagctatgaaactgtatagggctgtatatatacttgtctcagcttaatgcaggaaattggtttaatttccagcagttttgtctaaactgttcaaaaaaaaactatgaacagagttcaaatacaggactgtttgttttgaagagactttctaaagtgtacttaaaacatagtagttttttacctttcacaaaactgagttacaagaatacttttgttttacagtgcatcccttcctaggaagtctcattaaaacactcactttttctaggggtgattttgaatgctgcacagggaagggaaggaaataatagtcttaacttttcttaaaggataccagaaacattgctggatataatttaagattagtgttttctctttcatagaaagaacgtacatactgggacatgagtacagttacagcaagtctaggtgtgctaacaaaacagggcacattcaagtacagtaagattttgcttgaaattaaaaacaaactacatgagattaaagcattaaaatcatatttctcaatctgaatacatgttaaaaaaaaaaaatcaaaaggaacgcagaagtgctagctcacatttttaccatattacaaaagcaattggtacccatgtccataaaggcagcaacaaagctgcttgtctattgaagattactactgcaaattggactgcattcaatgctagttgtaaaaacaccagcttttcagaagttggtatctgtacaaaattgcagcttattttcttcacttctgtcccttcaagtctttacacagtaatgctaaaacacccagctttgagatcctgagtcaatatattgccactttctttttggtagcttgagcttcatagtgtcaactgaccttgtgtatccatttttaatacagtctcttcctgtagcatgggcaaatattttaaatcttcttccaaaaaagtgttttaagttatgatgttacaatggcaggactttttctttagggaaggaattcagttgtgctgcaatgtattagattctataggtggagcagagtcatatagtgtatctgtatcatgtgtaggctcaccagctaatgtacaaggattagacagtgttccagcaccacagtcacagaaaaacctaaagcaaaatgaaacccaaatattagaaaagtgagggggaaagtaattgggtaatatatcaagcaagtgtgctacatacctatcatgtctaataaactctacatcatgtccctgatggcacttcttaatgcagttcacacatatggcatttcgatctgtggtgttacaagtatgacatctaaaaagcaaaagcttaaattacttttctcaaacatgtcattaatgcaaaacattccattctgtttatatattactatgacctttggctttaagaggaccaaaacaaaattctttgtggctccagcccagattaattctgaaaaggaactttaatggagtaagtgattttcctgtcatctgtgtcttcggagggaagagaaatgatttgtaaattgtataaaggcagttctttccactttaaaagcctctcaaatgtttctgggctgaaaacaatttttggaggcgtgaagagtcaaaactgtcacagtgactgggatatatcaaacacttaaccccgacatctttaccttgaaatttctaggaaaacattacacaacatgagttacatgaatgacatcagttactgtagcattaggtttttccatagttatggtctttgttttgttttgtagagacagggtctccctatgttgcccaggctggtttagaactcctgggctccagtgatcctcccacttcagcctcccaaagtgctaggattacaggcataagccaccacgcctacccacagttacagtcttaaacacgatcttcaagtagattgatgataaaattttcagttagttatagtctcaacaccggcaaatagccaaaaatgctaggcattgctaatttaaaaaggaaatcagtcttcctcttttcaggactcaaatatatttctaagttacctgtagaaatcatgcatgggatagctggtataacttgatattttatataaacattggcctctactaacagccttttctatggcatcttgattgttcattattttgttatctgtaataaaagaaagaataagtaaaaattcagaggaatgttaatattttaaaaaccaaagattataggattattctaacagaagagccactatttttaagagctttaaatgaagctaaccaatgaagtaattgtaagaaatcagctaagaatagaattttccttgtataagatactccaaccatttagaaccaaagctctgtttctttcaaaatctatcttaaactgttgctaacttggagagtgacataaggaatcaagttataaaacggcttctgattatctttcatggcatattgcatatatttataggtatagcagactccaacatacctttcattgtcacattaacaccagatgctaaaaataagcctccaaaccggttgttaaaaatctgattgccttctagtgttgcagttgcgtgatttgtaatttcaatacctgaagtaaaatttacaaacaagtagatacatcactttatactgcttcttaaaaacctgaaattagcaagcaaatgtaaactgcttcttttatagaagtacattaaccctcttaatgtctactgaataaaatgtagatacctatttcaaccaccaacagtaacattcacttatcaatgactatggtcaaaactgcaattaactttcgcaccaacctaactgtcttaaagtttaaatacatgatacttggatttcatttgcatccattttaacatctctttttctgttgcagatttaaactggtaaattcatctgaggaattgaatctatctgtattcctagtggtaatacaagcctgcatttattctatcccaataaatgtttcataatcacga

SEQ ID NO: 156145 - DNA, 491 bp, Homo sapiens
  Payload ID: 10644
  Gene Symbol: MSH6
  Gene Name: mutS homolog 6
  ENST ID: ENST00000420813
  CDS Start-End: 189-491
gagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctca

SEQ ID NO: 156146 - DNA, 578 bp, Homo sapiens
  Payload ID: 10644
  Gene Symbol: MSH6
  Gene Name: mutS homolog 6
  ENST ID: ENST00000455383
  CDS Start-End: 232-578
gtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgt

SEQ ID NO: 156147 - DNA, 4158 bp, Homo sapiens
  Payload ID: 10644
  Gene Symbol: MSH6
  Gene Name: mutS homolog 6
  ENST ID: ENST00000445503
  CDS Start-End: 153-635
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 156148 - DNA, 548 bp, Homo sapiens
  Payload ID: 10644
  Gene Symbol: MSH6
  Gene Name: mutS homolog 6
  ENST ID: ENST00000411819
  CDS Start-End: 96-548
aattgggcggggcggggccgtggggagccgaagtgctgggatccggctgggtccttcgttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtc

SEQ ID NO: 156149 - DNA, 846 bp, Homo sapiens
  Payload ID: 10644
  Gene Symbol: MSH6
  Gene Name: mutS homolog 6
  ENST ID: ENST00000456246
  CDS Start-End: 107-421
ggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaagga

SEQ ID NO: 156150 - DNA, 4055 bp, Homo sapiens
  Payload ID: 10644
  Gene Symbol: MSH6
  Gene Name: mutS homolog 6
  Uniprot ID: P52701
  ENST ID: ENST00000538136
  CDS Start-End: 794-3970
gagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttatttttt

SEQ ID NO: 156151 - DNA, 3930 bp, Homo sapiens
  Payload ID: 10644
  Gene Symbol: MSH6
  Gene Name: mutS homolog 6
  Uniprot ID: P52701
  ENST ID: ENST00000540021
  CDS Start-End: 153-3845
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttatttttt

SEQ ID NO: 156152 - DNA, 833 bp, Homo sapiens
  Payload ID: 10644
  Gene Symbol: MSH6
  Gene Name: mutS homolog 6
  ENST ID: ENST00000606499
  CDS Start-End: 681-833
gttagccaggatggtctggatctcctgacctcgtgatccgcccgcctgtgcctcccaaagtgttgggattacaggcgtgagccactgtgcccagcctccagcatgatttttttaggccgttcttttgtttgaaagaattcaactaaggatccactctgcctgcctgaccggtttcttcctttcttctctctcatcgggtcccgagttcccatgactgcagcttccagaagagcagagctttggtatcctactcacagcgccaaaactgcaggggccaaggaaagatacaaaattcttgtgtgcagcctcttttggactccagctcttgttctctcgctgaatcccaccgccaccccttcaagtcatcggctgtgattcacctgtgggtttctgaaggctagaagcttccacaatgagccaggaaacaagttctgattggctgggaacagacctctgctccaagattcagggctggcagtattccttctgttctggtggctcgatcttcattgctttcctctggacttaaacaccctgttgcccaggctggagtgcagtgatgcaatcatagctcacaatggcctcgaactcctgggctcaagccatcctcccgtgtcagactcccaagtagctgggattacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagcca

SEQ ID NO: 156153 - DNA, 4150 bp, Homo sapiens
  Payload ID: 10644
  Gene Symbol: MSH6
  Gene Name: mutS homolog 6
  Uniprot ID: P52701
  ENST ID: ENST00000614496
  CDS Start-End: 889-4065
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttatttttt

SEQ ID NO: 156154 - DNA, 3429 bp, Homo sapiens
  Payload ID: 10644
  Gene Symbol: MSH6
  Gene Name: mutS homolog 6
  ENST ID: ENST00000616033
  CDS Start-End: 84-3287
cccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgcccgctgcccccggggcctctccttccccaggcggggatgcggcctggagcgaggctgggcctgggccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgctttt

SEQ ID NO: 156155 - DNA, 4324 bp, Homo sapiens
  Payload ID: 10644
  Gene Symbol: MSH6
  Gene Name: mutS homolog 6
  ENST ID: ENST00000622629
  CDS Start-End: 3249-4232
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagccattgtgtgcttgttactggaccaaatatggggggcaagtctacgcttatattcacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccatattagtagaagattattctcaaaatgttgctgtgcgctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatg

SEQ ID NO: 156156 - DNA, 1744 bp, Homo sapiens
  Payload ID: 10645
  Gene Symbol: MUTYH
  Gene Name: mutY DNA glycosylase
  Uniprot ID: Q9UIF7
  ENST ID: ENST00000354383
  CDS Start-End: 112-1680
cgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156157 - DNA, 1776 bp, Homo sapiens
  Payload ID: 10645
  Gene Symbol: MUTYH
  Gene Name: mutY DNA glycosylase
  Uniprot ID: Q9UIF7
  ENST ID: ENST00000355498
  CDS Start-End: 147-1712
tcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156158 - DNA, 1839 bp, Homo sapiens
  Payload ID: 10645
  Gene Symbol: MUTYH
  Gene Name: mutY DNA glycosylase
  Uniprot ID: Q9UIF7
  ENST ID: ENST00000372098
  CDS Start-End: 135-1775
ggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156159 - DNA, 1823 bp, Homo sapiens
  Payload ID: 10645
  Gene Symbol: MUTYH
  Gene Name: mutY DNA glycosylase
  Uniprot ID: Q9UIF7
  ENST ID: ENST00000372104
  CDS Start-End: 194-1759
ctccgtgttctgctgtcttcatcagcgtgggccgcgggtatctattgtgtacagtttacctggcactgactttggacacacaccaatcaacaagagaatcagtccttgcactcaagtcgttttttacagtcaaattcaggaagtacacactgatggaaagaatcaaagtaatgtaaaattacattaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156160 - DNA, 1809 bp, Homo sapiens
  Payload ID: 10645
  Gene Symbol: MUTYH
  Gene Name: mutY DNA glycosylase
  Uniprot ID: Q9UIF7
  ENST ID: ENST00000372110
  CDS Start-End: 135-1745
ggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156161 - DNA, 1888 bp, Homo sapiens
  Payload ID: 10645
  Gene Symbol: MUTYH
  Gene Name: mutY DNA glycosylase
  Uniprot ID: Q9UIF7
  ENST ID: ENST00000372115
  CDS Start-End: 217-1824
cagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156162 - DNA, 904 bp, Homo sapiens
  Payload ID: 10645
  Gene Symbol: MUTYH
  Gene Name: mutY DNA glycosylase
  ENST ID: ENST00000435155
  CDS Start-End: 32-904
ccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggca

SEQ ID NO: 156163 - DNA, 1692 bp, Homo sapiens
  Payload ID: 10645
  Gene Symbol: MUTYH
  Gene Name: mutY DNA glycosylase
  Uniprot ID: Q9UIF7
  ENST ID: ENST00000456914
  CDS Start-End: 63-1628
cgcggcgggaacgcggggcctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156164 - DNA, 1929 bp, Homo sapiens
  Payload ID: 10645
  Gene Symbol: MUTYH
  Gene Name: mutY DNA glycosylase
  ENST ID: ENST00000450313
  CDS Start-End: 217-1866
cagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgcctgtgcagggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtt

SEQ ID NO: 156165 - DNA, 1706 bp, Homo sapiens
  Payload ID: 10645
  Gene Symbol: MUTYH
  Gene Name: mutY DNA glycosylase
  Uniprot ID: Q9UIF7
  ENST ID: ENST00000448481
  CDS Start-End: 44-1642
ctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156166 - DNA, 772 bp, Homo sapiens
  Payload ID: 10645
  Gene Symbol: MUTYH
  Gene Name: mutY DNA glycosylase
  ENST ID: ENST00000412971
  CDS Start-End: 128-772
ctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagc

SEQ ID NO: 156167 - DNA, 507 bp, Homo sapiens
  Payload ID: 10645
  Gene Symbol: MUTYH
  Gene Name: mutY DNA glycosylase
  ENST ID: ENST00000485271
  CDS Start-End: 1-134
agaccccagtgaccaccgtaccaccaggtgctcgctggctgacgcaggaggaatttcacaccgcagctgtttccaccgccatgaaaaaggttttccgtgtgtatcagggccaacagccagggacctgtatgtagagacagggtttcaccatgttgactaggctggtctcgaactcctgacctcaagtgatctgcccatcttggcctcccaaagtgctgggattacaggcgtgagccaccacacccatccatgggagctatcagttctaattgggagacggatcaggaaaggctgtttggaggaagcagctgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156168 - DNA, 501 bp, Homo sapiens
  Payload ID: 10645
  Gene Symbol: MUTYH
  Gene Name: mutY DNA glycosylase
  ENST ID: ENST00000531105
  CDS Start-End: 195-383
cggggtctcgccgtcgggtcgccgatgggtcgaacttccgttcagacgtcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgta

SEQ ID NO: 156169 - DNA, 670 bp, Homo sapiens
  Payload ID: 10645
  Gene Symbol: MUTYH
  Gene Name: mutY DNA glycosylase
  ENST ID: ENST00000525160
  CDS Start-End: 161-328
ggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcagaagatgagatggacctggacaggcgggcatatgctgaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgttt

SEQ ID NO: 156170 - DNA, 740 bp, Homo sapiens
  Payload ID: 10645
  Gene Symbol: MUTYH
  Gene Name: mutY DNA glycosylase
  ENST ID: ENST00000488731
  CDS Start-End: 27-677
cgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatggaggtgaatcaactctgggctggcctgggctactattctcgtggccggcggctgcaggagggagctcggaaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtt

SEQ ID NO: 156171 - DNA, 673 bp, Homo sapiens
  Payload ID: 10645
  Gene Symbol: MUTYH
  Gene Name: mutY DNA glycosylase
  ENST ID: ENST00000529892
  CDS Start-End: 1-641
ggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcc

SEQ ID NO: 156172 - DNA, 1662 bp, Homo sapiens
  Payload ID: 10645
  Gene Symbol: MUTYH
  Gene Name: mutY DNA glycosylase
  ENST ID: ENST00000528013
  CDS Start-End: 55-1662
gaacgcggggcctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatgcctgtgcagggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtga

SEQ ID NO: 156173 - DNA, 1677 bp, Homo sapiens
  Payload ID: 10645
  Gene Symbol: MUTYH
  Gene Name: mutY DNA glycosylase
  ENST ID: ENST00000475516
  CDS Start-End: 112-234
cgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156174 - DNA, 839 bp, Homo sapiens
  Payload ID: 10645
  Gene Symbol: MUTYH
  Gene Name: mutY DNA glycosylase
  ENST ID: ENST00000470256
  CDS Start-End: 42-599
cgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtg

SEQ ID NO: 156175 - DNA, 1017 bp, Homo sapiens
  Payload ID: 10645
  Gene Symbol: MUTYH
  Gene Name: mutY DNA glycosylase
  ENST ID: ENST00000467459
  CDS Start-End: 1-555
gcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgggttcggggatctccgttcccagctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctg

SEQ ID NO: 156176 - DNA, 1225 bp, Homo sapiens
  Payload ID: 10645
  Gene Symbol: MUTYH
  Gene Name: mutY DNA glycosylase
  ENST ID: ENST00000533178
  CDS Start-End: 1-300
gccatcatgaggaagccacgagcagccgtgggaagtggtcacaggaagcaggcagccagccaggaagggaggcagaagcatgctaagaacaacagtcaggccaagccttctgcctgtgatggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaat

SEQ ID NO: 156177 - DNA, 788 bp, Homo sapiens
  Payload ID: 10645
  Gene Symbol: MUTYH
  Gene Name: mutY DNA glycosylase
  ENST ID: ENST00000483127
  CDS Start-End: 507-788
aacgcggggcctccgtgttctgctgtcttcatcagcgtgggccgcgggtatctattgtgtacagtttacctggcactgactttggacacacaccaatcaacaagagaatcagtccttgcactcaagtcgttttttacagtcaaattcaggaagtacacactgatggaaagaatcaaagtaatgtaaaattacattaggtaagagctacaaggcagaaatatgtgataggataagatgaggggacctgatttggacatttcagtcaagacttgaaaaatgataaggtgttaggtaaaagcataaaagagtccaaacagaggaaatggattgtgtgaggccccaaggtgggcagacacacttgaggtgtttaagcaactaaattcagtcaaccttggctagagcatagtgaggggatgaggcggatggtgcccggatcactggacctgcaaggctgtagtaagaggactgccttctaagagcaagggtgtggcagccaaatccctccaatggcctataaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgg

SEQ ID NO: 156178 - DNA, 989 bp, Homo sapiens
  Payload ID: 10645
  Gene Symbol: MUTYH
  Gene Name: mutY DNA glycosylase
  ENST ID: ENST00000467940
  CDS Start-End: 134-271
gagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggtacgctggacttgcggccatcatgaggaagccacgagcagccgtgggaagtggtcacaggaagcaggcagccagccaggaagggaggcagaagcatgctaagaacaacagtcaggccaagccttctgcctgtgatgcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacag

SEQ ID NO: 156179 - DNA, 1742 bp, Homo sapiens
  Payload ID: 10645
  Gene Symbol: MUTYH
  Gene Name: mutY DNA glycosylase
  ENST ID: ENST00000481571
  CDS Start-End: 135-299
ggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 156180 - DNA, 1029 bp, Homo sapiens
  Payload ID: 10645
  Gene Symbol: MUTYH
  Gene Name: mutY DNA glycosylase
  ENST ID: ENST00000529984
  CDS Start-End: 236-886
ggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggaggtgaatcaactctgggctggcctgggctactattctcgtggccggcggctgcaggagggagctcggaaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttattttatgttgtatttttttgagatgggggtctcgctatgttgctcagactggtttcgaactcaggtgattctggcctca

SEQ ID NO: 156181 - DNA, 965 bp, Homo sapiens
  Payload ID: 10645
  Gene Symbol: MUTYH
  Gene Name: mutY DNA glycosylase
  ENST ID: ENST00000461495
  CDS Start-End: 162-326
cggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgagacgtagctgaagtcacagccttccgagggagcctgctaagctggtacgaccaagagaaacgggacctaccatggagaagacgggcagaagatgagatggacctggacaggcgggcatatgctgaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgac

SEQ ID NO: 156182 - DNA, 2733 bp, Homo sapiens
  Payload ID: 10646
  Gene Symbol: MX1
  Gene Name: MX dynamin-like GTPase 1
  ENST ID: ENST00000288383
  CDS Start-End: 358-2277
tctacctgcctcagcctcccaaagtgctgagattacaggcgtgagccccggggcccggcctggagggatattcttgaagcgccttgagcagggaggcagcgtttgtctttatctgaccttggcttctttgggtcactctgtttctctttccgtgaataaaaagccagtgagcacacactgtgtcccaggcactcttctacgctctggggacatcaccatgaacaactagtcagagtccccacctccaggggccttccgttctggtggtgggtttggttccatggttgaatgcacccagctgcttatctgttcaataggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaca

SEQ ID NO: 156183 - DNA, 2850 bp, Homo sapiens
  Payload ID: 10646
  Gene Symbol: MX1
  Gene Name: MX dynamin-like GTPase 1
  Uniprot ID: P20591
  ENST ID: ENST00000398598
  CDS Start-End: 406-2394
tgagtttcatttcttcgcggcgcggggcggggctgggcgcggggtgaaagaggcgaagcgagagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaca

SEQ ID NO: 156184 - DNA, 3470 bp, Homo sapiens
  Payload ID: 10646
  Gene Symbol: MX1
  Gene Name: MX dynamin-like GTPase 1
  Uniprot ID: P20591
  ENST ID: ENST00000398600
  CDS Start-End: 1026-3014
agtctgaagtcatgcaatttgacttttcctttctggaaaccagcgagcagaaatgaaaccgaaactgaattgtccgggaaattcgcggtgggggcggagagcgcagggagaagtaagcccagtgcaggatcctgaggcccgtgtttgcaggaccagggccggccttccgattccccattcattccagaagcaccgaaccacgctgtgcccggatcccaagtgcagcggcacccagcgtgggcctggggttgccggttgacccggtcctcagcctggtagcagaggccaggccagtgccacaaggcacctaagtccacctgggcctggagcaggacaggttgcaaaagaaaatatctcgggacccccaaactccttatgctaagggaaacatcgagcctgggaactgagccatcaacgctgccattctttttcccaaacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaagccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaca

SEQ ID NO: 156185 - DNA, 516 bp, Homo sapiens
  Payload ID: 10646
  Gene Symbol: MX1
  Gene Name: MX dynamin-like GTPase 1
  ENST ID: ENST00000419044
  CDS Start-End: 440-516
atctgattcagcaggcctgggttcgggcccgagaacctgcgtctcccgcgagttcccgcgaggcaagtgctgcaggtgcggggccaggagctaggtttcgtttctgcgcccggagccgccctcagcacaggccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgc

SEQ ID NO: 156186 - DNA, 583 bp, Homo sapiens
  Payload ID: 10646
  Gene Symbol: MX1
  Gene Name: MX dynamin-like GTPase 1
  ENST ID: ENST00000441677
  CDS Start-End: 351-583
actccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagaggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcgggga

SEQ ID NO: 156187 - DNA, 905 bp, Homo sapiens
  Payload ID: 10646
  Gene Symbol: MX1
  Gene Name: MX dynamin-like GTPase 1
  ENST ID: ENST00000424365
  CDS Start-End: 315-905
tcttcgcggcgcggggcggggctgggcgcggggtgaaagaggcgaagcgagagcggaggccgcactccagcactgcgcagggaccggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagaggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataag

SEQ ID NO: 156188 - DNA, 872 bp, Homo sapiens
  Payload ID: 10646
  Gene Symbol: MX1
  Gene Name: MX dynamin-like GTPase 1
  ENST ID: ENST00000417963
  CDS Start-End: 269-872
gcggggtgaaagaggcgaagcgagagcggaggccgcactccagcactgcgcagggaccggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactca

SEQ ID NO: 156189 - DNA, 887 bp, Homo sapiens
  Payload ID: 10646
  Gene Symbol: MX1
  Gene Name: MX dynamin-like GTPase 1
  ENST ID: ENST00000413778
  CDS Start-End: 684-887
gacgggcaggagacagatgccttcctcttgtctcaactgcaagaggcacctaagtccacctgggcctggagcaggacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaagccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagaggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctg

SEQ ID NO: 156190 - DNA, 2810 bp, Homo sapiens
  Payload ID: 10646
  Gene Symbol: MX1
  Gene Name: MX dynamin-like GTPase 1
  Uniprot ID: P20591
  ENST ID: ENST00000455164
  CDS Start-End: 367-2355
atctgattcagcaggcctgggttcgggcccgagaacctgcgtctcccgcgagttcccgcgaggcaagtgctgcaggtgcggggccaggagctaggtttcgtttctgcgcccggagccgccctcagcacagggtctgtgagtttcatttcttcgcggcgcggggcggggctgggcgcggggtgaaagaggcgaagcgagagcggaggccgcactccagcactgcgcagggaccggaattctgtggccacactgcgaggagatcggttctgggtcggaggctacaggaagactcccactccctgaaatctggagtgaagaacgccgccatccagccaccattccaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagac

SEQ ID NO: 156191 - DNA, 281 bp, Homo sapiens
  Payload ID: 10646
  Gene Symbol: MX1
  Gene Name: MX dynamin-like GTPase 1
  ENST ID: ENST00000427464
  CDS Start-End: 177-281
cccagaagactggtactcctgagaggcagatgaagtggtggtctttgatatcgagcctgggatgccctgggcacatgaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcg

SEQ ID NO: 156192 - DNA, 1980 bp, Homo sapiens
  Payload ID: 10646
  Gene Symbol: MX1
  Gene Name: MX dynamin-like GTPase 1
  Uniprot ID: P20591
  ENST ID: ENST00000619682
  CDS Start-End: 22-1548
cttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagac

SEQ ID NO: 156193 - DNA, 3042 bp, Homo sapiens
  Payload ID: 10647
  Gene Symbol: MX2
  Gene Name: MX dynamin-like GTPase 2
  Uniprot ID: P20592
  ENST ID: ENST00000330714
  CDS Start-End: 185-2332
atttctctccctgtttgttgatgacggagcaggggagggagtggttcatatgccacataaaagtgaagtggaggaaagggaagagatgatttctccatcctgaacgtgcagcgagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccagaaggcgaccgaggagctgcggcgttgcggggctgacatccccagccaggaggccgacaagatgttctttctaattgagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaagttaaaaatattatccacgaagaagttgaaaaatatgaaaagcagtatcgaggcaaggagcttctgggatttgtcaactacaagacatttgagatcatcgtgcatcagtacatccagcagctggtggagcccgcccttagcatgctccagaaagccatggaaattatccagcaagctttcattaacgtggccaaaaaacattttggcgaatttttcaaccttaaccaaactgttcagagcacgattgaagacataaaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgta

SEQ ID NO: 156194 - DNA, 618 bp, Homo sapiens
  Payload ID: 10647
  Gene Symbol: MX2
  Gene Name: MX dynamin-like GTPase 2
  ENST ID: ENST00000435611
  CDS Start-End: 242-618
gaagtggaggaaagggaagagatgatttctccatcctgaacgtgcagcgggtcttcctgctctgtttcccaggctggagtgcaatggtaccatcatagctcactgcagccttaaacttccgggctcaagtgatcctcctgcctcggcctcccaatgcattgggattacagagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcgggga

SEQ ID NO: 156195 - DNA, 582 bp, Homo sapiens
  Payload ID: 10647
  Gene Symbol: MX2
  Gene Name: MX dynamin-like GTPase 2
  ENST ID: ENST00000436410
  CDS Start-End: 195-582
ataaaagtgaagtggaggaaagggaagagatgatttctccatcctgaacgtgcagcgcctttattaagctcctactgtatgccaggtactttgggctgcaggtacagctgtgaaaaaaaacagagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgg

SEQ ID NO: 156196 - DNA, 604 bp, Homo sapiens
  Payload ID: 10647
  Gene Symbol: MX2
  Gene Name: MX dynamin-like GTPase 2
  ENST ID: ENST00000418103
  CDS Start-End: 204-604
taaacagtcttgccttcctgcacgtggacatttttcttcatgcatatttctcttgcaaatggttctattgtttgtataacagtatttcatgagcggagaagagttggaagcaaaaatctgttcatgagaaatagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgt

SEQ ID NO: 156197 - DNA, 843 bp, Homo sapiens
  Payload ID: 10647
  Gene Symbol: MX2
  Gene Name: MX dynamin-like GTPase 2
  ENST ID: ENST00000416447
  CDS Start-End: 801-843
agaccttcaagttaattgttggaacctgcggctctaacacttccagcaaagctacttctgtgaaagctgtgacgagcagaggaaatgggacaggagaggagctgaatcctgagattgtatcgctaggagcccccaaagtacgatgacggtcctcgggccagcatgggggtgcattggcaccatgtaaggaaaggggccctcccgtggcaccgttggagtggggcggtgtggggttgttcggagagaaaagtttcccatgagctctgtttcagcaaacggcgatgaccacttccgtggcaactaaacagtcttgccttcctgcacgtggacatttttcttcatgcatatttctcttgcaaatggttctattgtttgtataacagtatttcatgagcggagaagagttggaagcaaaaatctgttcatgagaaatcctttattaagctcctactgtatgccaggtactttgggctgcaggtacagctgtgaaaaaaaacagcaggcgggaaccagccctgggacaggctccacacactcactgagcaccgcctcctgcacagcgcagtccctgctctcagcctgagcaggcgcagcagccctgccctcccaagaaaggggatggtgagaagcctagtgtcccctccacagagaccagcgccacacatgacagccacacatgacagtgttggtaccagcactcagtctttgagccacaagtgcttataagatagcttgtcaggaagatcggaggtgccaagtagcagagaaagcatcccccagctctgacagggagacagcacatgtctaaggcccacaagccttggccctaccggaggagaagtc

SEQ ID NO: 156198 - DNA, 4807 bp, Homo sapiens
  Payload ID: 10648
  Gene Symbol: MYBBP1A
  Gene Name: MYB binding protein (P160) 1a
  Uniprot ID: Q9BQG0
  ENST ID: ENST00000254718
  CDS Start-End: 308-4294
tccgagatgggcccttagaaatgcccccctggggctccaaaggggcagatgccacagccgccagggcggagcgggtgtgagcagaaggctgggaaagatgggacgccgctaggcgagggacttccgctcagagctacggcggaaatgccgctcttttaactctgggccggtctctcttggttcccccgcccctccgggttcttccgcctccgagccgacacaaaccggtgcgcatgcgccgtgccctgacctggaagcggctggggccggagcacacgtgtttcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcactcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctattttttttttttttttttaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaaca

SEQ ID NO: 156199 - DNA, 4104 bp, Homo sapiens
  Payload ID: 10648
  Gene Symbol: MYBBP1A
  Gene Name: MYB binding protein (P160) 1a
  Uniprot ID: Q9BQG0
  ENST ID: ENST00000381556
  CDS Start-End: 63-4061
ctgacctggaagcggctggggccggagcacacgtgtttcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcactcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacagactctgagattcacaatcagcagctctaaaaaataaaggagcagtttggcttccggaaggaagaggaggcaacactcgg

SEQ ID NO: 156200 - DNA, 3795 bp, Homo sapiens
  Payload ID: 10648
  Gene Symbol: MYBBP1A
  Gene Name: MYB binding protein (P160) 1a
  ENST ID: ENST00000573116
  CDS Start-End: 1-3757
cggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcactcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacagactctgagattcacaatcagcagctctaaaaaataaaggagcagtttggcttccggaaggaagaggaggcaaca

SEQ ID NO: 156201 - DNA, 613 bp, Homo sapiens
  Payload ID: 10648
  Gene Symbol: MYBBP1A
  Gene Name: MYB binding protein (P160) 1a
  ENST ID: ENST00000573723
  CDS Start-End: 1-613
acatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacagactctgagattcacaatcagcagctctaaaaa

SEQ ID NO: 156202 - DNA, 588 bp, Homo sapiens
  Payload ID: 10648
  Gene Symbol: MYBBP1A
  Gene Name: MYB binding protein (P160) 1a
  ENST ID: ENST00000572759
  CDS Start-End: 1-209
agagcgagggggaggagagcgaggaggaggagcgcgacggggacgtggatcagggcttccgggaacagctgatgaccgtgctgcaggctgggaagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtcc

SEQ ID NO: 156203 - DNA, 2922 bp, Homo sapiens
  Payload ID: 10649
  Gene Symbol: MSANTD1
  Gene Name: Myb/SANT-like DNA-binding domain containing 1
  Uniprot ID: Q6ZTZ1
  ENST ID: ENST00000438480
  CDS Start-End: 1748-2584
agggcttcctagaggaggtaggccttctagtcactccttcatctgcaggcactccacagagctctctgtgccagcccccagcacggagggctgaccttagtcgagtggagatgccccagtgccaggcagtagggatgatgtctcctgaggcccagatggaagggactggactagtctcatggggctgatggtggggccaggccttgaccagggacccagtgtagggggtgcagagacccctctgagttcctcacacatccctggggccctccccatacacttcctatcctgactgcgggcaagagggagccccagttcgccttccctatgctgggcacccacagtggggctgggcacccccgccatgcccctgccctgtccttcccctgagagcctcggtcccacctccaaggtgcctcagaggacagcaggggcagcgggcagaggccgagatgcctcctcattccaggctcagctgcccttcttggggcagcccacacctgagagtctcctgcagttggtcaggcctgaggagggcaggggggtgcctgctgtccctctgctgaccacagtggcatttagcctgggcaccgcgcccagcacagtccatgctgcacaggtgccgtgggctccacagagccctgcctgacatgcatgtgttacgtttcgggtgccgatgcccttgggcggcacttctccgggcagaacccccaggccaccgctccggttccggttccgctgcatctggggctctcggcaggctgtggtcctccggccagcctgggggcatctcagtccctcagccccacaggggcctgccccgcagcctgggcctcgagccccgtctccgcacgctgtgccgaatctggctgcccatcagctccctgcgtacccagactgtgccctgccatgcccgtggctcttcccaggagtgccctgtggcctccccctggcttgctgggctgattccctcctgtgtctcaaacagagctcacctttgccatcactgctgtcctcaccggccggtgccagaggcccgtgtctgtgtaccctgtgtctgcacctctgggcagggcctggctctgaccaacccgggcttccagtgtccacagacctaaggcccagggcgcctgggggctggagcaagagaagcaaaaggagccaagggtgggggtttggggttcttgtgagggcccagccccaggaccccaggaccaggacacccaggagccccagggcccagccccagttcagaaggcaggggccttctgagggagcttaagggtcccacagcccaggacccccaccagggccagtggccagcgttgggggactcagcctcctcgtcgctcgtcctctctgtttctcccaccttttgccccctttctccttgcctgttcccacccgaggccccctcttggcctgcgtgagccggggcggcactgaactgggggccgatccgcctgggcggcggtgagaggcagggccgggagccgggccgctgggtttgggcctggcccgctcgccgcaatattgatggcccgtcagtgcagccctgattcctgtgctttcagttaaaaggtttctgttgttgtagcttatgcagttgctctgttgctatggaaacgtgacatcaaaatgacgtttcccgtttaaaagcttttaactaaattcctgcctgtcagatgtaggccccattttgagcgtggagctgccttcgagcgagcgtgagcggcgcctcccgcccatggtgcgtggggccgggccggggccctcgctgagcgcgctctctcaccccacaggcgcctccggcatggcggcggccgaggggcccggctacctcgtgtctccccaggcggagaagcaccggcgggcccgcaactggacggacgccgagatgcgcggcctcatgctggtctgggaggagttcttcgacgagctcaagcagaccaagcgcaacgccaaggtgtacgagaagatggccagcaagctcttcgagatgaccggcgagcgcaggctgggcgaggagatcaagatcaagatcaccaacatgaccttccagtacaggaaattaaaatgcatgacagatagcgagtccgccccgcccgactggccctattacctagccattgatgggattctggccaaggtccccgagtcctgtgatggcaaactgccggacagccagccgccggggccctccacgtcccagaccgaggcgtccctgtcgccgcccgctaagtccacccctctgtacttcccgtataaccagtgctcctacgaaggccgcttcgaggatgatcgctccgacagctcctccagcttactgtcccttaagttcaggtcggaggagcggccggtgaagaagcgcaaggtgcagagctgccacctgcagaagaagcagctgcggctgctggaggccatggtggaggagcagcgccggctgagccgcgccgtggaggagacctgccgcgaggtgcgccgcgtgctggaccagcagcacatcctgcaggtgcagagcctgcagctgcaggagcgcatgatgagtctgctggagaggatcatcaccaagtccagcgtctaggccagcaggcggcggcggcggcggggccgggcggctggtggtactgctcaggccacccagggcaggccactcaggccaggcgggcaagggggccgccccgcgagcggagaccgccttccacctggcctctggcaggatgtcccttctgaggggtattttgaggaacccccaggccctggggaccgtgaggctccagtctccagcatgaatgcccttcctcggacacaggccagggcctctggggttcactccgagtaagaacgtcctagagccactctccagtgtcgttactatcaatgatacttgacgtggctttgatattaaacgtatactttttc

SEQ ID NO: 156204 - DNA, 2039 bp, Homo sapiens
  Payload ID: 10649
  Gene Symbol: MSANTD1
  Gene Name: Myb/SANT-like DNA-binding domain containing 1
  ENST ID: ENST00000510580
  CDS Start-End: 65-922
agatgtaggccccattttgagcgtggagctgccttcgagcgagcgtgagcggcgcctcccgcccatggtgcgtggggccgggccggggccctcgctgagcgcgctctctcaccccacaggcgcctccggcatggcggcggccgaggggcccggctacctcgtgtctccccaggcggagaagcaccggcgggcccgcaactggacggacgccgagatgcgcggcctcatgctggtctgggaggagttcttcgacgagctcaagcagaccaagcgcaacgccaaggtgtacgagaagatggccagcaagctcttcgagatgaccggcgagcgcaggctgggcgaggagatcaagatcaagatcaccaacatgaccttccagtacaggaaattaaaatgcatgacagatagcgagtccgccccgcccgactggccctattacctagccattgatgggattctggccaaggtccccgagtcctgtgatggcaaactgccggacagccagccgccggggccctccacgtcccagaccgaggcgtccctgtcgccgcccgctaagtccacccctctgtacttcccgtataaccagtgctcctacgaaggccgcttcgaggatgatcgctccgacagctcctccagcttactgtcccttaagttcaggtcggaggagcggccggtgaagaagcgcaaggtgcagagctgccacctgcagaagaagcagctgcggctgctggaggccatggtggaggagcagcgccggctgagccgcgccgtggaggagacctgccgcgaggtgcgccgcgtgctggaccagcagcacatcctgcagatccagacggcagctcagcccattgcacacctgcatttcctcagcgtggacgtggggcaggcgcgccttccagttgctcgggcaggacgttgaaaagatgtggacccaggggtcaagacctcacacactcgaccattttcactccatcacggacatttggaagtgaccggcgtttcacactgcagctgtgcggtgcgaaaacccctcagggctgcgccggggctcggggcctgcctgcgttcctgctcaggtcttgccacatcagtgcgcatgtcagctccgtgaagaccccgtgaagaccccgtgatcatcagactatgatgaaagcagctgcaacctcagggacccttggtgacccacaggccgagacctgagaaccactgcctgaatgctggagcgggcacacaggtgacctgagcgagcctcgtctgtccttgcccggtacccagagctggctcactggcgattggtggacgcacgggcgctgtcacacaaaggggccctccgtgtgactgggtggcgtcatcacagacagcgtgtgggaaccgtgcccccaagcgggcccagagggactccctgctgtcttgtaggcactggggatagggtcaggtggaaagcagatacaaatctttgtctttacagggtttcgagttgagggtggggctagaccaacaataaacacgtaagtgtctagtatgttagaagagaggtgctttccagggaaataaggctgtagggggattggagccgtggggtgagagaaaaggccttcaaaaaatgtcatgtgagcggatggagtgggaggggcgccctcacctgagcactgggagctgcactgtctaggtgggagctggctctgagggcgaggtgggcctggacagggacaccctgctttctgctgggacaagagagtcccggagcagggagggtcaggtgtggcgtggagcctgggaggtgggtgaggggtgctcaggaggcatcctggcctaggggaggatagaatggttggactggcacaggccttggctgttgcccgggcatggggaaaaaccagaacctctgtgtgctggctttgcgctcgtggccatctccaggactcagaacatgcgagaggcacgcaaggtggagcgtgtgggagaaggtgctgcctgtggtttcagcccaagttcatctcagctgggtccggagggagagggcaccctacccctag

SEQ ID NO: 156205 - DNA, 2289 bp, Homo sapiens
  Payload ID: 10649
  Gene Symbol: MSANTD1
  Gene Name: Myb/SANT-like DNA-binding domain containing 1
  ENST ID: ENST00000507492
  CDS Start-End: 844-1641
cagagactagagctgtgttctcacagggcccaccacccttccacctccttggccattgacacctgcgtccctggcccagctgctcccaggtaacccccaaagcagctggcacatcccacctctggtgtggccggggctgctgtgtgtccgcagggcctgccccgtctattctagcttgtttgtcctgtctgaaccagcgcctactccaagaagcctctgctcagcccagcggggatgcttctaagctccggacgagcctctcggaagccttggtgattggtggtgtagtcatcttgggatgcagatgtcttaccaacctgcaagaacaaaaaccctgtggcttcctctggtgcagggtgacaccgctccagggccccccagtggcctctcctttcagagctacctaaattctggtcacttcagagaaatggagcacccccttctccctggtccaggtgtggacagcctggcacactgagcacacctggcatggctggtaatttcagaaagaagaggggccggggtccagtgggaagcagcggtgaacccctcgtgagtgggctttgcagtccctccccatgccacggcagagctgccctcaacacagccttcctcttcctcatcggagagcacaccctgtccccttgccgagctgtgccctgtgccttcggtggtatttgattttggctgctactggctttgttgggatctggaagtcgcttcccctgcgtggtgcgtggagcactgtaagtcagatgagggaagtagccagggtgaggtgctgctggttgaccagcctctggccctaggagaccccgtagcgactgagggtcccagcaggccatgcagctttgccaaggcgcctccggcatggcggcggccgaggggcccggctacctcgtgtctccccaggcggagaagcaccggcgggcccgcaactggacggacgccgagatgcgcggcctcatgctggtctgggaggagttcttcgacgagctcaagcagaccaagcgcaacgccaaggtgtacgagaagatggccagcaagctcttcgagatgaccggcgagcgcaggctgggcgaggagatcaagatcaagatcaccaacatgaccttccagtacaggaaattaaaatgcatgacagatagcgagtccgccccgcccgactggccctattacctagccattgatgggattctggccaaggtccccgagtcctgtgatggcaaactgccggacagccagccgccggggccctccacgtcccagaccgaggcgtccctgtcgccgcccgctaagtccacccctctgtacttcccgtataaccagtgctcctacgaaggccgcttcgaggatgatcgctccgacagctcctccagcttactgtcccttaagttcaggtcggaggagcggccggtgaagaagcgcaaggtgcagagctgccacctgcagaagaagcagctgcggctgctggaggccatggtggaggagcagcgccggctgagccgcgccgtggaggagacctgccgcgaggtgcgccgcgtgctggaccagcagcacatcctgcaggtgcagagcctgcagctgcaggagcgcatgatgagtctgctggagaggatcatcaccaagtccagcgtctaggccagcaggcggcggcggcggcggggccgggcggctggtggtactgctcaggccacccagggcaggccactcaggccaggcgggcaagggggccgccccgcgagcggagaccgccttccacctggcctctggcaggatgtcccttctgaggggtattttgaggaacccccaggccctggggaccgtgaggctccagtctccagcatgaatgcccttcctcggacacaggccagggcctctggggttcactccgagtaagaacgtcctagagccactctccagtgtcgttactatcaatgatacttgacgtggctttgatattaaacgtatactttttcattcttgcctggaacgcacagtttgctgttgctggcttggtgaggatgccctgattgatggatcccgaaaatgaaagcagatggaaacgggttggggcaggctggagctgggggagctctctcctgaagggaaccctgtgtcctccctcaccaggacctctgcgtctctccttaaatggcctctgacgcctgatgaaaaccccagcgaccttccaggaggcttttattcagctctgtttggagcatcaggtgtttccactgcctccttagcaatgacactaataaaagtcgtaacacctgttcacatgca

SEQ ID NO: 156206 - DNA, 3164 bp, Homo sapiens
  Payload ID: 10649
  Gene Symbol: MSANTD1
  Gene Name: Myb/SANT-like DNA-binding domain containing 1
  ENST ID: ENST00000505599
  CDS Start-End: 184-987
gtgctttcagttaaaaggtttctgttgttgtagcttatgcagttgctctgttgctatggaaacgtgacatcaaaatgacgtttcccgtttaaaagcttttaactaaattcctgcctgtcagatgtaggccccattttgagcgtggagctgccttcgagcgagcgtgagcggcgcctcccgcccatggtgcgtggggccgggccggggccctcgctgagcgcgctctctcaccccacaggcgcctccggcatggcggcggccgaggggcccggctacctcgtgtctccccaggcggagaagcaccggcgggcccgcaactggacggacgccgagatgcgcggcctcatgctggtctgggaggagttcttcgacgagctcaagcagaccaagcgcaacgccaaggtgtacgagaagatggccagcaagctcttcgagatgaccggcgagcgcaggctgggcgaggagatcaagatcaagatcaccaacatgaccttccagtacaggaaattaaaatgcatgacagatagcgagtccgccccgcccgactggccctattacctagccattgatgggattctggccaaggtccccgagtcctgtgatggcaaactgccggacagccagccgccggggccctccacgtcccagaccgaggcgtccctgtcgccgcccgctaagtccacccctctgtacttcccgtataaccagtgctcctacgaaggccgcttcgaggatgatcgctccgacagctcctccagcttactgtcccttaagttcaggtcggaggagcggccggtgaagaagcgcaaggtgcagagctgccacctgcagaagaagcagctgcggctgctggaggccatggtggaggagcagcgccggctgagccgcgccgtggaggagacctgccgcgagatatcccgttgttacagcaccgtttgtagaagagggtgtcctgtcgctatggagtggctttggactctttcttgaagatggatggcctgtggatgtgtcgggcccgctctggagtctgcatcctgtccattgataatgatgtcagtcctcacgtcagtacacactttcctgattactcaggtgctgtgcctgagtgtccaaggccaatttctgacgctacattctggagtgttctactgacaccatctgccaggacccacacttccaagaatccccacctgtgtgcttctagagcagacagatggggtcagagctcagggcgggtggggtctggagtccggcctcccccaacagcccacctgctccccgcccggccgcctggcgcagaggccctagtttggagagcccattcacgctcggaatttggattcaaccacggggctgaccccccacctccctcattttccaaaacgcctttgtcttttcctgttcaaagaactttcaagagactttccaagttttgttcgggaacagtgtggctccccagggtgccagctggcatcttgtgcaattatcattaaattacagggacaattttaatttcatgataattagaaatatcaactgccgctcagccttcgaaactaatggaattttaatgggcagctgcttaggttacagctaagaatagcagcgctccaccgagcggctgcagcagggccctgagtgggcgccagcctccatgtgggagccgtgcccagggagccggggcacctggtgtgggctgcgggaggcaggccctgggtgaaccttcagcagctgcctgtaagggagaaaatgggaccgtcctggtcaggtggaggagacctgtgtcctggactttggaccccgaggccagcccattacccctgcaatgcagccccaggtccacctgccccacagccacagcctcagggcttggagctgagcctgcgacctcagactgtgccctctggggagcccacccactctgggcctcggcagcctgggctgaccaagaccttccactctgagcaaatctgcaagccgggggagccccaggccctcagacggaaggcgccctcactccttcctcttgtccttagaattacagtccaaggcccggaaacagtcattccccatgttctgtccagttttccagtcatttgaagcagggatggaggagaggtgaatccagagcttgtcactccatcctggtggaaagtggaattaatggtgtctttcaattgggcagattttgcttttgataatatcaaattttagctaattttttttatggctaaaacattttgtgtcctaagaaatcttcaccaaggccagggagatattttcccatattgtattctagaagctgtggttacatctgggtctctgtccatctcaattgctttgtaggaaatgaaatggatatcagagccattttttccacgtgattcccctgttattccagaactgtttgttagaaagcctgccctttccctatcgcgagtgtctggtgcctttgtcaaaaagcaattcacagaacaggagggggtctattattattattattttttttttttttgagatggagtttcattcttgtcacccaggctggagtgcagtggcacgatctcagctcgctgcaacctccgtctcccagattcaagcaattctcctgcctcagcctcccaagtacctgtgattacaggcatccaccatcatgcctggctaatttttttttttttgcatttttagtagaggcggggtttggctgcgttggccaggctggtcttgaactcctgacctcaggtgaacctcccgcctcgcctcccaaagtgctgggattacaggcgtgaggcaccacgcccggccgagcgggtctattttgagacaccattcggtcctgttggtctgtgcgtctgcattatcttggttactgtgcctttatagaaaatcttcaggtcacctagtgtaagtcttccaaacttcttcttttccaaaactgtttttgctaatccatatattttgccattctgtataaattttaaatcaccttattgatttctatccccaaaaaagcctgctgaaatttgtattgagatggaattgaattcatagtcccacttgataagaactgacatgttgaaaatattgtcttacaatttatgaacatggtgtatctcaccatttggagctgtctaatacatcctttattaaatttatttatcagt

SEQ ID NO: 156207 - DNA, 2495 bp, Homo sapiens
  Payload ID: 10650
  Gene Symbol: MSANTD2
  Gene Name: Myb/SANT-like DNA-binding domain containing 2
  Uniprot ID: Q6P1R3
  ENST ID: ENST00000239614
  CDS Start-End: 294-1817
aatctgttcctcactccagcgccctcatgcccccacccttctcttcagctcggggcttcggcgcgcctcgtccccgcccttcgccccgggagaggagcgggcggcgtgggagggctcgcggagaaaggcccaggggagtggacgacctccgcccggcagccacatcctcagcagcagagacccggagccatccgcccgcgggcgagccaggcccgagggcagccccggagaccgcggtggccggatgcgcgggcgcgtcacttccgggcggtgcagcggcggccgcttggaagatggctgcgccctgtggctcggagctgcccgccaactcgccgctaaaaattccgaagatggaggtgctttccccggcttctcctggtggcctgagcgacggaaatccatcgctgtccgacccttccacgcctcggggtgcctccccgctcgggccgggcagtgcggcgggctcgggggcagcggcgtccgggggtctcgggctggggctggggggccgcagcgccgcctcgtcctcggtctccttctcccctggtggcggcggtggcggggctgcggcagccgccgccgccgcctgccggggcatgtcgtggacgccagccgagacgaacgcgctcatcgcagtgtggggcaacgagcggctggtggaggcgcggtaccagcagctggagggagccggcacggtgttcggcagcaaggcccccgggccagccatgtacgagcgcgtgtcccgggccctggccgagctgggctacgagcggaccccgtcccagtgccgggagcgcatcaaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggcaagttaaatcttgattcacagttaaaaagactttttcaatatcacccttagctactattgtatataatttagattttcatttttttcaccagccaagtgttttgctatttccaatcagtattgcttgcaaagacctttgtttctgtgatgtaccaactttacagttgtgttgccatttaaacctttttttaaaaaaaaaaaattaaagtaattcctggcc

SEQ ID NO: 156208 - DNA, 2349 bp, Homo sapiens
  Payload ID: 10650
  Gene Symbol: MSANTD2
  Gene Name: Myb/SANT-like DNA-binding domain containing 2
  Uniprot ID: Q6P1R3
  ENST ID: ENST00000374979
  CDS Start-End: 10-1689
gcttggaagatggctgcgccctgtggctcggagctgcccgccaactcgccgctaaaaattccgaagatggaggtgctttccccggcttctcctggtggcctgagcgacggaaatccatcgctgtccgacccttccacgcctcggggtgcctccccgctcgggccgggcagtgcggcgggctcgggggcagcggcgtccgggggtctcgggctggggctggggggccgcagcgccgcctcgtcctcggtctccttctcccctggtggcggcggtggcggggctgcggcagccgccgccgccgcctgccggggcatgtcgtggacgccagccgagacgaacgcgctcatcgcagtgtggggcaacgagcggctggtggaggcgcggtaccagcagctggagggagccggcacggtgttcggcagcaaggcccccgggccagccatgtacgagcgcgtgtcccgggccctggccgagctgggctacgagcggaccccgtcccagtgccgggagcgcatcaagacccttcgcaggtgttacagtcgggtgaaagaacatggtgttgggaaaagaaagagcagttacacatttgaacagttggaacaggtgtttggtcagggaggatgggatgctcagccctgccagcctgtacttattaacagtagtggcttgtaccaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggcaagttaaatcttgattcacagttaaaaagactttttcaatatcacccttagctactattgtatataatttagattttcatttttttcaccagccaagtgttttgctatttccaatcagtattgcttgcaaagacctttgtttctgtgatgtaccaactttacagttgtgttgccatttaaacctttttttaaaaaaaaaaaa

SEQ ID NO: 156209 - DNA, 1109 bp, Homo sapiens
  Payload ID: 10650
  Gene Symbol: MSANTD2
  Gene Name: Myb/SANT-like DNA-binding domain containing 2
  ENST ID: ENST00000524950
  CDS Start-End: 4-543
aagatggctgcgccctgtggctcggagctgcccgccaactcgccgctaaaaattccgaagatggaggtgctttccccggcttctcctggtggcctgagcgacggaaatccatcgctgtccgacccttccacgcctcggggtgcctccccgctcgggccgggcagtgcggcgggctcgggggcagcggcgtccgggggtctcgggctggggctggggggccgcagcgccgcctcgtcctcggtctccttctcccctggtggcggcggtggcggggctgcggcagccgccgccgccgcctgccggggcatgtcgtggacgccagccgagacgaacgcgctcatcgcagtgtggggcaacgagcggctggtggaggcgcggtaccagcagctggagggagccggcacggtgttcggcagcaaggcccccgggccagccatgtacgagcgcgtgtcccgggccctggccgagctgggctacgagcggaccccgtcccagtgccgggagcgcatcaagatgaaatacctgtcacaaagagaacattaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctg

SEQ ID NO: 156210 - DNA, 775 bp, Homo sapiens
  Payload ID: 10650
  Gene Symbol: MSANTD2
  Gene Name: Myb/SANT-like DNA-binding domain containing 2
  ENST ID: ENST00000527140
  CDS Start-End: 11-637
cgcttggaagatggctgcgccctgtggctcggagctgcccgccaactcgccgctaaaaattccgaagatggaggtgctttccccggcttctcctggtggcctgagcgacggaaatccatcgctgtccgacccttccacgcctcggggtgcctccccgctcgggccgggcagtgcggcgggctcgggggcagcggcgtccgggggtctcgggctggggctggggggccgcagcgccgcctcgtcctcggtctccttctcccctggtggcggcggtggcggggctgcggcagccgccgccgccgcctgccggggcatgtcgtggacgccagccgagacgaacgcgctcatcgcagtgtggggcaacgagcggctggtggaggcgcggtaccagcagctggagggagccggcacggtgttcggcagcaaggcccccgggccagccatgtacgagcgcgtgtcccgggccctggccgagctgggctacgagcggaccccgtcccagtgccgggagcgcatcaagtggcttgtaccaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacagaagagagacatcatgcagaatattgtacagattttggaatcggtacagttgaaatgggaactttttcagagctggacaga

SEQ ID NO: 156211 - DNA, 3086 bp, Homo sapiens
  Payload ID: 10650
  Gene Symbol: MSANTD2
  Gene Name: Myb/SANT-like DNA-binding domain containing 2
  Uniprot ID: Q6P1R3
  ENST ID: ENST00000526629
  CDS Start-End: 1449-2438
gtgaaaatagttaacatattggcttatggagagcaatctcacgtttaggataaatttagtctggcagtgcctacaaattaagtctgaggtgaactacttttgaacagttgagttagaaagtatttggtagccaccagggaaaagagatcttatttcaagaaaataattagtgaaactcagtaaagtagaagggagattagaaggaacaaagggaggcagagatgggatagagactggttgcaacttaactaaatttggaagctgggattaagcccttgatttatcttttgaaatgccatataagatagcataagatgtaccattaaattcaggaaactgggctaataatcagaaatatgtgttagaaataaagaccatggtaaaaatggaagggttgtacaagagaataaaattattcaggttttgtctgtggatttgcataatgatatttatttgctgtgtgccacatggcagaaaaggaagtgaaataacacccctctgtcccgtccttttccccagaaagaaatcactggcttcatttgttggtttgtttagctggcagcttgagttggtagaacagacgagtagattgtctagctttagacgtaggtattagtgtactgtttcttgatcattgatgtttgagacctggaatttgtagcattattgatttgacctctgttttaaattttagcggcttccacaaagactgagttagtaaggaatacaactatgtaagtaatatgttttactagctaatttgtctaggcaattatttttaccctgtattcattccttcttaatcaagagtaaggcaggtattctttgctttgggaaattcttctttctgtcctcccttccctcactttttccaaattctgggcacaacagcagctctctctcttctgtggcaggtgtgcatcctattggctggctggtatttcttgttttttttcccccttattctttttaaatgggggtgggggtataaaaatatgtgtatggggtacatgcaataatgttgtaatgtttcttgttgtttaatggataattaattgcaaaataattgttttaattataacatgtttgagtaaatgctaaattagtatttttttctaatataataatgaatttgaaatctagcattcctgtaacaatgtgtctatgtttgtctgtctgtgtctgtctaatagtaattaatatctgtggtccgtacctggaagaggaagtacagctttaaaggaataacaaaagactttgtgtcttagacccttcgcaggtgttacagtcgggtgaaagaacatggtgttgggaaaagaaagagcagttacacatttgaacagttggaacaggtgtttggtcagggaggatgggatgctcagccctgccagcctgtacttattaacagtagtggcttgtaccaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggcaagttaaatcttgattcacagttaaaaagactttttcaatatcacccttagctactattgtatataatttagattttcatttttttcaccagccaagtgttttgctatttccaatcagtattgcttgcaaagacctttgtttctgtgatgtaccaactttacagttgtgttgccatttaaaccttttttt

SEQ ID NO: 156212 - DNA, 786 bp, Homo sapiens
  Payload ID: 10651
  Gene Symbol: MSANTD3
  Gene Name: Myb/SANT-like DNA-binding domain containing 3
  Uniprot ID: Q96H12
  ENST ID: ENST00000374885
  CDS Start-End: 151-630
gttcgggagcccgcggccctcccggccgccctgcttgcgagaggagcccaggccgcccgccctcgcgcctcgccggcccctcccccggtcgccgcggctgccgcgccgccgctgcaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagttttctttcaagaaagaaaaagaagcctggaattgtcaatcatcctttctgggacttggtaggaaaaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcag

SEQ ID NO: 156213 - DNA, 710 bp, Homo sapiens
  Payload ID: 10651
  Gene Symbol: MSANTD3
  Gene Name: Myb/SANT-like DNA-binding domain containing 3
  ENST ID: ENST00000374886
  CDS Start-End: 168-710
gggggtggggggcgcgggccgggcgtagagggggccgggggccggcatggagggttttcgggccgagccgctgcgaccccggccttgcaggctgggcgccgggcggccgcctctgcgcgccgcgatgggactcggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaa

SEQ ID NO: 156214 - DNA, 1362 bp, Homo sapiens
  Payload ID: 10651
  Gene Symbol: MSANTD3
  Gene Name: Myb/SANT-like DNA-binding domain containing 3
  Uniprot ID: Q96H12
  ENST ID: ENST00000395067
  CDS Start-End: 272-1099
acggaccggcaggcggcgggcggtccgcgagggggcggcggcgtccgggctttgtggccgcggcgcgcgcggcggggcctggccggccgggggcgcgccgccgccgccgccgccgcccggcgttcgggagcccgcggccctcccggccgccctgcttgcgagaggagcccaggccgcccgccctcgcgcctcgccggcccctcccccggtcgccgcggctgccgcgccgccgctgcaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaag

SEQ ID NO: 156215 - DNA, 780 bp, Homo sapiens
  Payload ID: 10651
  Gene Symbol: MSANTD3
  Gene Name: Myb/SANT-like DNA-binding domain containing 3
  ENST ID: ENST00000398977
  CDS Start-End: 378-780
ttgtggccgcggcgcgcgcggcggggcctggccggccgggggcgcgccgccgccgccgccgccgcccggcgttcgggagcccgcggccctcccggccgccctgcttgcgagaggagcccaggccgcccgccctcgcgcctcgccggcccctcccccggtcgccgcggctgccgcgccgccgctgcaggaatttcccagtccagtgtgggagatggacgcaaagagcaaattgcaaaaaatatgggaagtgctacagtacagtcatgtacaactgtcagtgagctcatagaagagtaactcattctgagccagtgggaactcagggccaatctatatctaacaaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccg

SEQ ID NO: 156216 - DNA, 1755 bp, Homo sapiens
  Payload ID: 10651
  Gene Symbol: MSANTD3
  Gene Name: Myb/SANT-like DNA-binding domain containing 3
  Uniprot ID: Q96H12
  ENST ID: ENST00000613183
  CDS Start-End: 183-1010
cagtccagtgtgggagatggacgcaaagagcaaattgcaaaaaatatgggaagtgctacagtacagtcatgtacaactgtcagtgagctcatagaagagtaactcattctgagccagtgggaactcagggccaatctatatctaacaaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccacgtgtgagtgttgttgttgttgtttttttttttaatcaaatgcaagtgtgactataaaggagtgtggctgatttttttttttttcttttttctttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgaggaagaaatgttcgtttagatttctacattctgttatgttggttttatt

SEQ ID NO: 156217 - DNA, 1748 bp, Homo sapiens
  Payload ID: 10651
  Gene Symbol: MSANTD3
  Gene Name: Myb/SANT-like DNA-binding domain containing 3
  Uniprot ID: Q96H12
  ENST ID: ENST00000622639
  CDS Start-End: 176-1003
gcgggggcgggggtggggggcgcgggccgggcgtagagggggccgggggccggcatggagggttttcgggccgagccgctgcgaccccggccttgcaggctgggcgccgggcggccgcctctgcgcgccgcgatgggactcggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccacgtgtgagtgttgttgttgttgtttttttttttaatcaaatgcaagtgtgactataaaggagtgtggctgatttttttttttttcttttttctttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgaggaagaaatgttcgtttagatttctacattctgttatgttggttttatt

SEQ ID NO: 156218 - DNA, 4087 bp, Homo sapiens
  Payload ID: 10652
  Gene Symbol: MSANTD4
  Gene Name: Myb/SANT-like DNA-binding domain containing 4 with coiled-coils
  Uniprot ID: Q8NCY6
  ENST ID: ENST00000301919
  CDS Start-End: 1417-2454
ggcgaccgtggggaggtgccgccggggtcgcaggtgagcggttctatgctggaggaggcggccagggaagcggcggctccgtgaccagtgggtgccctcgcagtgggtagggtcccggaggggtcagcggcaattggcgcaacgcttgctgccgggtttggtccaagggctgcgacgtagcgggactgcacgctcgggagaagtgccacgcgcgtctgtcgcctgaccggggaggctggggagggcccaggccacggaaacaagactgcagaagtttctgggcactcagtcgggactctcatttaatacccagagagaggagatcttccaggttgccccgactcccaccgggactcctaccagcagcaacctcatcattgtggccgaggcaggtgcgcgcccctgctcccctgggtggccttccgggagcccagtctaactcgattcttcccaggggctctttttggacggtcccaaaggaggcagcgggagggaggtgaaagatactttgataaccgtcgacccataagtatacttgttatgcacctaccacgagttttagagaagaacatactttttggcagggaagtgaatcccctataagaatataggggaggggaaagccacactttaaagagaatttgggtagggtttgatattgtagatttgtgatgcttttcttcttgaactgcttaactaatttaccctcaaatttttttgatccggaacttgccgtctggtttttctcagacttcttaattctgacttatcatgaagtatctaggaacttcattctcaagttttagtgcttgtaaaaagttgcctggttatattatgccattggcagtacatcatcttcacaaggattacgtaagtgaactacatctcattcctgtttccaactagtgaagaacgattgtgaaatgggattttagaaaatggctgttctctgtgattgggcatagaaggtttgtaagttttagagactgcagctgttgaatcctttctgctaagagagcgatgacaggcaatagaaaagggatagtgtttgacatctaaaatgacatattttcacattttatgaggtgttatatccccagcaccaaaaatagtgcctttcacacagtaggagctcagtaagtattttttgaggaaattattggggaatgaatggatggtagaaaacccaagcttctgttacttggataccggcatataaaggagaggacaggaagacaaacatttctggaaatggcttttatccaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctggttggttcaggatttccccttccctcctctgatttggatgactctctcactgaagagatagatgaaaagattggattccgaaatgatgcaaattttgactggcaaaatgtggcagatttcagggatgcaggtggatccttaactgaggtcaaggtggaagaggaagaaagggatccgcagagtcctgaatttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaaggctgcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttaccttataatattacatagagtcttgtattgtctgtgtacccagagtttacaattatgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacgtagctttaatacagctcttctgttgacagttattactttaattttgcatttgttccttgtaagaatggctggaaactgtgtgttgacatttgaggatgggtatgcaaggaaaaaatatacttctgtttacttactctgactttgaaatagtgttatttttctatatctgaaataaatgcttctaccatagaaataaatttgcctatactatctga

SEQ ID NO: 156219 - DNA, 612 bp, Homo sapiens
  Payload ID: 10652
  Gene Symbol: MSANTD4
  Gene Name: Myb/SANT-like DNA-binding domain containing 4 with coiled-coils
  ENST ID: ENST00000534458
  CDS Start-End: 280-612
atcttttttcctaccccccttggggcgaccgtggggaggtgccgccggggtcgcaggtgagcggttctatgctggaggaggcggccagggaagcggcggctccgtgaccagtgggtgccctcgcagtgggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctggttggttcaggatttccccttccctcctctgatttggatgactctctcactgaagagata

SEQ ID NO: 156220 - DNA, 948 bp, Homo sapiens
  Payload ID: 10652
  Gene Symbol: MSANTD4
  Gene Name: Myb/SANT-like DNA-binding domain containing 4 with coiled-coils
  ENST ID: ENST00000530788
  CDS Start-End: 360-948
attgtgaggccaggcctagggcgggctctcagccagaatggctacaccattctaaccaatggatgagactcatcaaatgagcggcagccatatgagccattggggtggcgggagatgggcgggcccagttagtgggcgggggatcaatgaagcatcttttttcctaccccccttggggcgaccgtggggaggtgccgccggggtcgcaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctggttggttcaggatttccccttccctcctctgatttggatgactctctcactgaagagatagatgaaaagattggattccgaaatgatgcaaattttgactggcaaaatgtggcagatttcagggatgcaggtggatccttaactgaggtcaaggtggaagaggaagaaagggatccgcagagtcctgaatttgaaattgaggaggaggaagaaatgttgtcatccgtcataccagattccaggagagaaaatgaacttcccgatttcccccacattgatgagttttttacccttaactcaacaccatctagatctg

SEQ ID NO: 156221 - DNA, 780 bp, Homo sapiens
  Payload ID: 10652
  Gene Symbol: MSANTD4
  Gene Name: Myb/SANT-like DNA-binding domain containing 4 with coiled-coils
  ENST ID: ENST00000530108
  CDS Start-End: 566-780
atcttttttcctaccccccttggggcgaccgtggggaggtgccgccggggtcgcaggtgagcggttctatgctggaggaggcggccagggaagcggcggctccgtgaccagtgggtgccctcgcagtgggtagggtcccggaggggtcagcggcaattggcgcaacgcttgctgccgggtttggtccaagggctgcgacgtagcgggactgcacgctcgggagaagtgccacgcgcgtctgtcgcctgaccggggaggctggggagggcccaggccacggaaacaagactgcagaagtttctgggcactcagtcgggactctcatttaatacccagagagaggagatcttccaggttgccccgactcccaccgggactcctaccagcagcaacctcatcattgtggccgaggcaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaag

SEQ ID NO: 156222 - DNA, 508 bp, Homo sapiens
  Payload ID: 10652
  Gene Symbol: MSANTD4
  Gene Name: Myb/SANT-like DNA-binding domain containing 4 with coiled-coils
  ENST ID: ENST00000617528
  CDS Start-End: 3-407
agatgaaaagattggattccgaaatgatgaattttgactggcaaaatgtggcagatttcagggatgcaggtggatccttaactgaggtcaaggtggaagaggaagaaagggatccgcagagtcctgaatttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaagggcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtc

SEQ ID NO: 156223 - DNA, 7785 bp, Homo sapiens
  Payload ID: 10653
  Gene Symbol: MYSM1
  Gene Name: Myb-like, SWIRM and MPN domains 1
  Uniprot ID: Q5VVJ2
  ENST ID: ENST00000472487
  CDS Start-End: 41-2527
gcgggatctctcgggaggacggacggggtcaggtcccatcatggcggctgaagaggcggatgtggatatcgaaggggacgtggtagcggcggcgggggcacagccaggaagtggtgaaaatacagcatcagttttacaaaaagatcactatcttgattcatcttggagaacagagaatggccttattccttggaccttggataacaccatcagtgaagagaacagagctgttattgagaaaatgttgttggaagaagaatattatttatctaaaaaatcacaaccggaaaaagtctggcttgatcaaaaggaagatgataaaaaatacatgaagagtctgcagaaaacagcaaaaatcatggtacactctcctacaaaaccagccagttactcagtaaagtggacgatagaagaaaaagagctgtttgaacaagggctggctaaatttggccgaagatggaccaaaatttcaaagctaattggaagccgcactgttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccagaacgctatttgaaaattagaaattatattttggatcaatgggagatatgcaaaccaaaatacttaaataagacctcagtacgtcctggcctgaagaactgtggagatgttaattgtattggacggattcatacatacctcgaattgataggagcaatcaattttggatgtgaacaggctgtgtataataggccacaaacagttgacaaagtacgaatcagagacagaaaagatgcagtagaagcataccaacttgcccagcgtctgcagtctatgcgtacaaggagacgtagggtccgagacccatggggaaactggtgtgatgcaaaggacttagaaggacaaacgtttgagcatctctctgctgaggagttggcaaaaagaagagaagaggaaaaaggcagacctgttaaatctttaaaagtgccaagaccaacaaaaagctcgtttgatcccttccaactgataccttgtaatttttttagtgaagaaaagcaggagccatttcaggtgaaagtggcttcagaagcacttttaataatggatttgcatgctcatgtttctatggcagaagtgattggtctgttaggaggaagatactcagaagttgataaagtagttgaagtctgtgcagcagaaccatgtaacagtctgagtacaggactacagtgtgagatggatcctgtatcacaaacacaggcctcagaaaccttggctgttagaggcttcagtgttattggatggtatcattctcatcctgcttttgatcctaatccttccttacgagatattgacacacaagctaaataccagagttacttctccagaggaggtgcaaagttcattgggatgattgttagtccctataatcgaaataatcccttaccatattctcagattacctgcctggttataagtgaggaaattagcccagatggctcttatcgcttaccttacaaatttgaagtacagcagatgttagaagaacctcagtggggattagtatttgaaaagacaagatggataatagaaaaatacaggctctcccatagcagcgtccccatggataaaatctttcgccgggattctgacctgacttgtttgcagaaacttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaaggaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatgttccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatgttacatattcagcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccagtattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatattttacaattgtatctgtatgaaatgaatgtattaatattttagattaaaacattttgtttagaagttcagttttttcttatgaggctaaaaaaaattaaaacatttttgtgggcttctaaaaaactgtgggccttaggtactgtgcctaatggataagttggcattgcctgtattctgaagggcatcattggaaaaatagcagtcattattctgtccccttctcccaccaccacagtccttggagaagcctttgccactccatccaggagcactgcagtttccacggttatagatctatagacttgaacttacttccttcccaacctaacgaaaactcacaaggattacttgggaccattcatcctcaaaaaagataggaggcagtggtttgttttagtcttcagatatttttgttttggtcagtccctaatctgtagttttgaaactcgtgccacacttgaaagggaaacatcctactacctttctttcctctccatttcccacaaaccctttccttcatcatcactccctgcattcttacttctcagcatataaatacaagacccttctttctattatttgttgaaagctaggcctgtaaaatagagatggacagaccatgcatgtttccatgaagctatttaatgctgctcccagtcttctgtccataccattccttccctgcccctaggagtggggttgaggtctgtgacatgcagactgtaagcacagtcagaacctctgcagctctcaacccaacagaggagactgtggcttcaacatgccaacctgagcaggtctcctctgcattaccttcctcccatttctcttcctgggtcctgatgaggtgagctggaggaaccaatagtcaggatgccctggaattgatgttgctctgttttgtgctcacaaaacagccatgtaacacatgagcacctgagttgaagccatccagtcgcaagtcagcagacagcagttgatggaattctcagtagaaattcagtaagggtgcccaaattttattttttttttcacctatactctaccaatatatggtatttaggaaaacttcttttatccaagcacaaagaaaagcacacacatttttataatcatctgcttcatcagggtaaataaataatttaacaaatttgatcagcatctctagtttaccagtactttaatattagttttcttacaaattaatgtattttgcaatatttccagaaaatcactgtgggagaataatgtaatatactttaggatatatttcctgaccttttcttaaatggcttcatgtgctattcccccaaattctgctttctctattttcttttttatttaacctataattatactttctagtatattctgagtctatcttctaagccaccttacatttttcctggaacaagggagggaataaatagttgcctccactaaatcaggaaaaaataaaaatatcccaggggagctgtgattatgccaagagctctaaacagaagtttgagaaggtaaaaattaagttgtagtatctgagttgtttttattttcttcctttggtgtttatgaaggtattcataagaactttaatttcaggggaaaaaaatgcctgatttgctatttttgacatttcctcgtctcttaagaagtcagttaaatatgttttcatagtttatattcctgtttcatagattactgtgaaacatgtatttaaacctatgaattataaaatagtatttagattctagcgtgagttaaatagattagtcatatatcttttagatttgtggatttgacatgtaaattatgtgttgtgtataagtaagttagttactaaacatatggcatggttattgataaacttgttgctatttttttccaaatgctatcagtgtttgtggacttttaaaaattagtttgaattttggaatgttctgtgataaaatgtaatttcaactattttgtacatttaaatatgccatgttgtatatgtctgtatttaaaaatgttgtaaatacctgcattttaagaattatgaaagattttcctcaaaaatgacagaactctccatacttaattgtgacacattataagatatctgattttaagcttttggattttgttctaaaaattaagtttaaacatgctgaaaattccataaaaataaaattttgaaaataaagtga

SEQ ID NO: 156224 - DNA, 6020 bp, Homo sapiens
  Payload ID: 10653
  Gene Symbol: MYSM1
  Gene Name: Myb-like, SWIRM and MPN domains 1
  Uniprot ID: Q5VVJ2
  ENST ID: ENST00000622766
  CDS Start-End: 70-774
tggagaaaagccaaacaattgcatgtttccatattttagagaaaataaattaatcatgctcatgtttctatggcagaagtgattggtctgttaggaggaagatactcagaagttgataaagtagttgaagtctgtgcagcagaaccatgtaacagtctgagtacaggactacagtgtgagatggatcctgtatcacaaacacaggcctcagaaaccttggctgttagaggcttcagtgttattggatggtatcattctcatcctgcttttgatcctaatccttccttacgagatattgacacacaagctaaataccagagttacttctccagaggaggtgcaaagttcattgggatgattgttagtccctataatcgaaataatcccttaccatattctcagattacctgcctggttataagtgaggaaattagcccagatggctcttatcgcttaccttacaaatttgaagtacagcagatgttagaagaacctcagtggggattagtatttgaaaagacaagatggataatagaaaaatacaggctctcccatagcagcgtccccatggataaaatctttcgccgggattctgacctgacttgtttgcagaaacttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaaggaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatgttccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatgttacatattcagcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccagtattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatattttacaattgtatctgtatgaaatgaatgtattaatattttagattaaaacattttgtttagaagttcagttttttcttatgaggctaaaaaaaattaaaacatttttgtgggcttctaaaaaactgtgggccttaggtactgtgcctaatggataagttggcattgcctgtattctgaagggcatcattggaaaaatagcagtcattattctgtccccttctcccaccaccacagtccttggagaagcctttgccactccatccaggagcactgcagtttccacggttatagatctatagacttgaacttacttccttcccaacctaacgaaaactcacaaggattacttgggaccattcatcctcaaaaaagataggaggcagtggtttgttttagtcttcagatatttttgttttggtcagtccctaatctgtagttttgaaactcgtgccacacttgaaagggaaacatcctactacctttctttcctctccatttcccacaaaccctttccttcatcatcactccctgcattcttacttctcagcatataaatacaagacccttctttctattatttgttgaaagctaggcctgtaaaatagagatggacagaccatgcatgtttccatgaagctatttaatgctgctcccagtcttctgtccataccattccttccctgcccctaggagtggggttgaggtctgtgacatgcagactgtaagcacagtcagaacctctgcagctctcaacccaacagaggagactgtggcttcaacatgccaacctgagcaggtctcctctgcattaccttcctcccatttctcttcctgggtcctgatgaggtgagctggaggaaccaatagtcaggatgccctggaattgatgttgctctgttttgtgctcacaaaacagccatgtaacacatgagcacctgagttgaagccatccagtcgcaagtcagcagacagcagttgatggaattctcagtagaaattcagtaagggtgcccaaattttattttttttttcacctatactctaccaatatatggtatttaggaaaacttcttttatccaagcacaaagaaaagcacacacatttttataatcatctgcttcatcagggtaaataaataatttaacaaatttgatcagcatctctagtttaccagtactttaatattagttttcttacaaattaatgtattttgcaatatttccagaaaatcactgtgggagaataatgtaatatactttaggatatatttcctgaccttttcttaaatggcttcatgtgctattcccccaaattctgctttctctattttcttttttatttaacctataattatactttctagtatattctgagtctatcttctaagccaccttacatttttcctggaacaagggagggaataaatagttgcctccactaaatcaggaaaaaataaaaatatcccaggggagctgtgattatgccaagagctctaaacagaagtttgagaaggtaaaaattaagttgtagtatctgagttgtttttattttcttcctttggtgtttatgaaggtattcataagaactttaatttcaggggaaaaaaatgcctgatttgctatttttgacatttcctcgtctcttaagaagtcagttaaatatgttttcatagtttatattcctgtttcatagattactgtgaaacatgtatttaaacctatgaattataaaatagtatttagattctagcgtgagttaaatagattagtcatatatcttttagatttgtggatttgacatgtaaattatgtgttgtgtataagtaagttagttactaaacatatggcatggttattgataaacttgttgctatttttttccaaatgctatcagtgtttgtggacttttaaaaattagtttgaattttggaatgttctgtgataaaatgtaatttcaactattttgtacatttaaatatgccatgttgtatatgtctgtatttaaaaatgttgtaaatacctgcattttaagaattatgaaagattttcctcaaaaatgacagaactctccatacttaattgtgacacattataagatatctgattttaagcttttggattttgttctaaaaattaagtttaaacatgctgaaaattccataaaaataaaattttg

SEQ ID NO: 156225 - DNA, 1890 bp, Homo sapiens
  Payload ID: 10654
  Gene Symbol: MYPOP
  Gene Name: Myb-related transcription factor, partner of profilin
  Uniprot ID: Q86VE0
  ENST ID: ENST00000322217
  CDS Start-End: 88-1287
cgagccctgacccaccggcggctgcggcggagccgcgccggcgccccccatgcgccagacggcaggacggcggcgtcggggggcgccatggcctcggcggcggcgggcgaagcggaggaaaccacccggttgcgcaagccgcgcttctcattcgaagagaaccagatcctgatccgcgaggtgcgcgcccactacccgcagctctacggcgcgcagagccgtcgggtgagcgtggcagagcggcggcgcgtgtgggacggcatcgccgccaagatcaacggtatcaccagctggaagcgcacgggccaggaggtgcagaagcgctggaacgacttcaagcgccgcaccaaggagaagctcgctcgcgtgccgcactccacgcagggcgccgggcccgccgcggaggacgctttctccgcggaagaggagaccatttttgccatcctggggccaggtgtggcggcgccgggggcaggtgctggggcggaggagccccctgcggccccctcttcacagccgccgcccccaagcgcctgccctcagcgctacgtgttgtcggaagaccgccgggaggaccgacgtgcagatacatcagcccacagcaaggcgggctccagcagcccggagccatgggcccggccctcctgcactccccaggaagggggctgcccacggcccaaggagcgtgagtcaccacccccttcggccctgcagccggtccagctgcctcgcctggccttgtctccaccacccccagcccctccactgccacccccaccgccactggcccaagtggcaccctcaccccctagccccccaccccctcctcggcctccacccacgctctcggcctcagacccctccctggacttcctgcgggcccagcaggagactgccaacgccatccgggagctggccggcacccttcgacagggactggccaaactgagcgaggccctcagcgctctgctgccccttctgccaggaaccccagttgactccctgcctccacctctgcccccacccccacccccaccgccacctcccaggcctgtcctgcccccaccggcccccaaggtggagatcaccccagagcccgtgtccgtggtggctgctgtggtggacggggcagtggtggcagccaggggagtgatcattgccccaaggagcgaggagggggcaccccggccccccccagccccgctccctccgcacgactcccccccacacaagcggagaaaaggtttccctacacggaaaaggcgcggccgatggaaatctccgtgaaatctactatctatgatcctgcctgcaacccctctccccagcttggcgcagtcgaggggggcgatgctctctgcccatcccagctgcaccctagctccctgctccagggatgtgagcacccactccctgtgctagttagtgcctgattctctggggggggcctcagtaatgggcccccccaacccctttctctggtacagtgctgtctgcctggctgcctcccttaaccctgacttctaagccatcaatttcatgttatttattattgccctatgtggggtggggagggaacctctcgggtctgcacatctccccttccctaacagttcctgttcttgacttgaagagaattgacccgtgggggactccccacctccccaacccagactttggagcgggtgggagttgtaagacaaatcaaaatacggatgacaaagaggatatagccgtgtataccccagggagaggaggcgccgagttctgatgggagaggtacaggttgggttctctgcctaccattgctgtctctgacttccagagctcaaccccctcctttctcccagtggtgacaagatatcaataaacttatttttaatacaatta

SEQ ID NO: 156226 - DNA, 897 bp, Homo sapiens
  Payload ID: 10655
  Gene Symbol: MAX
  Gene Name: MYC associated factor X
  Uniprot ID: P61244
  ENST ID: ENST00000246163
  CDS Start-End: 171-461
ggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaagctctatttcctcttttggaaattgtgtactcctgtccttcatcgtcaaagtttgatgcagaaatgccacaccttcatttcaagctaccaagtgcacaagaaaaaagaatgcaagatttaaaaaatgattgttttgaccccttacacaaatgtcttactcctggctttaattaagctgcttgagggctgatagctctgccttaccctggtaatcagcaaaatggtcctgtggctggggaggccctggcagcaggaagccttcaaggagccatgggtctgtgctgactctggccttacaaccttccagcctcctttgctggcattgatggggttccatttttgaatgaactagtttaatgtggatccaaatttattgtgcatattctttcgttttggttttcaaaagatggcttattcacatggaaatgtacaccagtttagccctgggccctccctttaccttcatatgtgtaaaagcttacacaggtttcagaaaataaatggtttcattttctctaaaataactagtacaaaataaaacagatgtcagttgttga

SEQ ID NO: 156227 - DNA, 3155 bp, Homo sapiens
  Payload ID: 10655
  Gene Symbol: MAX
  Gene Name: MYC associated factor X
  Uniprot ID: P61244
  ENST ID: ENST00000284165
  CDS Start-End: 150-554
gtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggtgagcacccgagctcgtggggcagctggccctgctgtgctccagccaggtcaggctttggcacctgggcctgcagagtcagagccagtcatggagtatgtgctcagtagcaggcttggtcctgcttcttggggcctgagtaactgagtgttagagccgtcctgaggaaggacctgaggcgccagtgaggagacagtggaagctaggaagttggacatctggagacttgtatcttttctggcctgacctctccccttcttggggctcaggtgctctgcctgcagtagggatcacacctggcatcaggtgtctgaaaagagctttgaggtccttggagtggaatgtgctgtgtaagtaccagagactccaggtgttcagggacagtgagccctccccattgtcaatggtagtccaatcagggcagcctatgggctaggcccatgctgttctcaatgctcacacccgccttttcctacaaccacaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaatgggttgaccttccaggctcaagctgagctgaaccaagggatgggcagtgggtggtgtcagtgggttggttactgggccaggcagcctgcatgtaggggctatttgaaaagcccaggtattttatgtgtattggtgacttgcttccaagtgtccagcttgtcattccaagtggatcttgtacacgagagctaagccaaaactgttctttggctgatacgtcttatgtcatcctttcctgctgttgtgtggcctcacaccttgtggagcctcatgctcctgggccagcttctcctctgttattgcactgctgaatcccacagggagctcacgctccagtctctccacggggcttccacggcaggacggtgacatcacaagccttctcttcagagttgggtgggattgcagagtgtctgctggctcccaggtccagctgggaaaggcgggagggaaatgaagtgtgtgagtgaacagccacccgaagggagctacttctgagcatcttgagcctcgggggccaacaagcaagcccttaggaagaacaggctggaccctgagtctgagactcggttactccccaagtctccagaaggcagtaacacactcccttggttgccttttagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatac

SEQ ID NO: 156228 - DNA, 330 bp, Homo sapiens
  Payload ID: 10655
  Gene Symbol: MAX
  Gene Name: MYC associated factor X
  Uniprot ID: P61244
  ENST ID: ENST00000341653
  CDS Start-End: 49-300
ttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaagggaacaaagatgaagttaaccctcccacctgtctttccttatgaacacttgccttttccaactgttttctgccatggctaatcagaaaaagtttcttaaggaaatggtggc

SEQ ID NO: 156229 - DNA, 1973 bp, Homo sapiens
  Payload ID: 10655
  Gene Symbol: MAX
  Gene Name: MYC associated factor X
  Uniprot ID: P61244
  ENST ID: ENST00000358402
  CDS Start-End: 166-621
ttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatccttctt

SEQ ID NO: 156230 - DNA, 1546 bp, Homo sapiens
  Payload ID: 10655
  Gene Symbol: MAX
  Gene Name: MYC associated factor X
  Uniprot ID: P61244
  ENST ID: ENST00000358664
  CDS Start-End: 132-614
gagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatcttt

SEQ ID NO: 156231 - DNA, 2097 bp, Homo sapiens
  Payload ID: 10655
  Gene Symbol: MAX
  Gene Name: MYC associated factor X
  Uniprot ID: P61244
  ENST ID: ENST00000394606
  CDS Start-End: 181-492
gcagtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaattccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 156232 - DNA, 1673 bp, Homo sapiens
  Payload ID: 10655
  Gene Symbol: MAX
  Gene Name: MYC associated factor X
  ENST ID: ENST00000555932
  CDS Start-End: 132-380
gagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgactccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactat

SEQ ID NO: 156233 - DNA, 585 bp, Homo sapiens
  Payload ID: 10655
  Gene Symbol: MAX
  Gene Name: MYC associated factor X
  ENST ID: ENST00000556443
  CDS Start-End: 179-556
agtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggtgagcacccgagctcgtggggcagctggccctgctgtgctccagccaggtcaggctttggcacctgggcctgcagagtcagagccagtcatggagtatgtgctcagtagcaggcttggtcctgcttcttggggcctga

SEQ ID NO: 156234 - DNA, 728 bp, Homo sapiens
  Payload ID: 10655
  Gene Symbol: MAX
  Gene Name: MYC associated factor X
  ENST ID: ENST00000557277
  CDS Start-End: 421-714
cgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggaggaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaattccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcag

SEQ ID NO: 156235 - DNA, 623 bp, Homo sapiens
  Payload ID: 10655
  Gene Symbol: MAX
  Gene Name: MYC associated factor X
  Uniprot ID: P61244
  ENST ID: ENST00000553928
  CDS Start-End: 22-333
ccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaaccacctggtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggcca

SEQ ID NO: 156236 - DNA, 571 bp, Homo sapiens
  Payload ID: 10655
  Gene Symbol: MAX
  Gene Name: MYC associated factor X
  ENST ID: ENST00000557746
  CDS Start-End: 179-544
agtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggtgctctgcctgcagtagggatcacacctggcatcaggtgtctgaaaagagctttgaggtccttggagtggaatgtgctgtgggaaagcgagagctgatcaagttctttgttcctggggaattca

SEQ ID NO: 156237 - DNA, 474 bp, Homo sapiens
  Payload ID: 10655
  Gene Symbol: MAX
  Gene Name: MYC associated factor X
  ENST ID: ENST00000556892
  CDS Start-End: 344-474
caagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggaggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctc

SEQ ID NO: 156238 - DNA, 574 bp, Homo sapiens
  Payload ID: 10655
  Gene Symbol: MAX
  Gene Name: MYC associated factor X
  ENST ID: ENST00000555667
  CDS Start-End: 179-463
agtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaaccacctgggttagaaaacctcaaataaaataaaat

SEQ ID NO: 156239 - DNA, 615 bp, Homo sapiens
  Payload ID: 10655
  Gene Symbol: MAX
  Gene Name: MYC associated factor X
  Uniprot ID: P61244
  ENST ID: ENST00000556979
  CDS Start-End: 179-490
agtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaat

SEQ ID NO: 156240 - DNA, 765 bp, Homo sapiens
  Payload ID: 10655
  Gene Symbol: MAX
  Gene Name: MYC associated factor X
  ENST ID: ENST00000555419
  CDS Start-End: 1-375
atgagcgataacgatgacatcgaggtggagagcgacgaagagcaaccgaggtttcaatctgcggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccagg

SEQ ID NO: 156241 - DNA, 2141 bp, Homo sapiens
  Payload ID: 10655
  Gene Symbol: MAX
  Gene Name: MYC associated factor X
  Uniprot ID: P61244
  ENST ID: ENST00000618858
  CDS Start-End: 206-517
tgcgtgccgccgttgatccggtgctgcagtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaaccacctggtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatccttctt

SEQ ID NO: 156242 - DNA, 2818 bp, Homo sapiens
  Payload ID: 10656
  Gene Symbol: MYCBP
  Gene Name: MYC binding protein
  Uniprot ID: Q99417
  ENST ID: ENST00000397572
  CDS Start-End: 801-1112
cacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagaga

SEQ ID NO: 156243 - DNA, 750 bp, Homo sapiens
  Payload ID: 10656
  Gene Symbol: MYCBP
  Gene Name: MYC binding protein
  ENST ID: ENST00000494695
  CDS Start-End: 64-234
agtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaa

SEQ ID NO: 156244 - DNA, 14736 bp, Homo sapiens
  Payload ID: 10657
  Gene Symbol: MYCBP2
  Gene Name: MYC binding protein 2, E3 ubiquitin protein ligase
  Uniprot ID: O75592
  ENST ID: ENST00000357337
  CDS Start-End: 94-14016
ggcggcggcagtggcggcaccgcctcctcctcacattcccggggtggcggggttagatgagcggccccagtagcggcgccgggggcgctgttcatgccggttcccgacggctccgtggctgctgcggggctggggctggggctacccgccgcggactcccggggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaaggcctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaactaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacagctaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaggagttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtct

SEQ ID NO: 156245 - DNA, 3660 bp, Homo sapiens
  Payload ID: 10657
  Gene Symbol: MYCBP2
  Gene Name: MYC binding protein 2, E3 ubiquitin protein ligase
  ENST ID: ENST00000429715
  CDS Start-End: 1-3184
aaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaa

SEQ ID NO: 156246 - DNA, 14664 bp, Homo sapiens
  Payload ID: 10657
  Gene Symbol: MYCBP2
  Gene Name: MYC binding protein 2, E3 ubiquitin protein ligase
  Uniprot ID: O75592
  ENST ID: ENST00000544440
  CDS Start-End: 19-13941
gcgccgggggcgctgttcatgccggttcccgacggctccgtggctgctgcggggctggggctggggctacccgccgcggactcccggggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaaggcctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaactaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacagctaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaggagttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtctacc

SEQ ID NO: 156247 - DNA, 364 bp, Homo sapiens
  Payload ID: 10657
  Gene Symbol: MYCBP2
  Gene Name: MYC binding protein 2, E3 ubiquitin protein ligase
  ENST ID: ENST00000466564
  CDS Start-End: 1-251
acagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtaggtatttaaaagtaagtcttttacttacctaacttcaatattttttattaccttctcttttatacactttttatttgtgttcacccagaaatctttattaaattaaaatttgttcatggaaagctaataaaaaatgtttacaaag

SEQ ID NO: 156248 - DNA, 1542 bp, Homo sapiens
  Payload ID: 10657
  Gene Symbol: MYCBP2
  Gene Name: MYC binding protein 2, E3 ubiquitin protein ligase
  ENST ID: ENST00000612956
  CDS Start-End: 67-894
cactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcgaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagt

SEQ ID NO: 156249 - DNA, 5347 bp, Homo sapiens
  Payload ID: 10658
  Gene Symbol: MINA
  Gene Name: MYC induced nuclear antigen
  Uniprot ID: Q8IUF8
  ENST ID: ENST00000333396
  CDS Start-End: 584-1981
gtgcccacgctgccccgcctccagccgctgcgccgcaacgcagtgggctcgcggccgcgagcaacaggccgtgccgggtgagtggggcgctctcgtgggcatcccagcgccggggcaggccgggtagtgcccgatcccgcggggcgcgcgctgctgctttaggcacccgggctcgggtgcgggtctgggagacctgtcggtcggcgagaagcctcggtggccggcgctgtggttgcgggacctgggacgcgctcccaggcgtcccacctccccggagactggggcagggtgggtggggcccggatctaggggtagggtcgcggaagccttggttacagagagtcgcacacgtggcctgctaatggtcgcgacaccggtgacgagcgcacggaaagtttggaggcttagcaaggagggtggtgccggcctccgcccggtggtggcagaactgcctgtgcgagcacggcttccacgtgggctgcgccgccgggcgtcatgtcgggcctaagagacacgctctacagctgtgaaatctgaagttcaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactctactcacgtgaccatcagcacctaccagaacaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaagctcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaactgaggtttctgttatttagtagagaaatcaactccacgtttacttaaagagatggtaaggtcaaggttcaaatgctactgtgttttaatttggatatttgaaatttctcttgaggcaaaaaaaaaaaaaaattgatgcctctccttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagaggctggagaaaatgttcattctgctcagtgatccaggagtgtgaggacagtagcttcctttccacgtccacaagacaatgacagatgtgtttccttctttgctctttctagggatctttctagggatgttgattctctcacaatatttcaatgtcccatttctgtgtttcttctccctccaggggctgatttacaattacatgagtcttgtcacaataatttcctcctaaaatagaaattccaaaagaaaagattatttgttcaggcaggtgcttagcaatttcacaattttcacaagcttctgttcagctcaccatttcggtggatgaatgtgtcatttacaaagaagtctgaaatgggaagctgagtttgaacaggcttagccattattcacctcaaattggaccttattatgactcaaattgaaatactaaaaggtataatacatgattgtataagtggcgtgccttaatgtgattctttagaacaaagtgctcttgagagaactctggctgaatgtcaggtactgtgtttttgtttctacaccaacaaaactgtgactaacccaattaaagcaacagccatgaataatattggccctgaccttgctgaattcaaaaacaaggttaattgatacctaccataaattctacctgagggtttttaaggaccatggcaattcctggcaaaaagctagagatgtttctaagaaacagatgacattcatttcatggtttatggtgcttgaaatttagaactgttctgagttcacgtagcaaatgaaagttttacaactgtactaatgaacaaaaaccctaagctttgttgtttggctttttctgctaattgttttgtttgtaaaactgcctatcttaattttcttcaagcataattttaaatgacttaacatttctcttatacataaggatgtcctttacccaaaatgaggagatttggaactgaaactaatatccagggacacaacattgggtatcatcaaaggcccacctttaacatcaaggacaagttgatcactgagataagagctgatagttccatttttattcagtctccacttctgcctgaattgcccatgttcagtccatagagctactttagctccaggtgtgtcccggccaccaatcacatcaagacatgtatcactggcctaaaagggttaagaaatgattaattggcagtagtatgtttgctaaagtaagttgaattaggtcccttttatcttaggtaaacaagtcatagacatgaagtgtgtgtgtgtcttatctaaaaaaatactatatagtataatttcagtaagccttttttaatgtcttctttacggctgtgggtaggagatggtacagaaataaaccaactgaaatagaggtacttgtttttaataggatgtctacatctgacaacagatgttcaataaagatttggtgaattggaattaaatgttaaatccctgtttgcttaaaacgtattatgttgagcttggttttcttatgaaaacattgcatgatgggctaaagatatccagacaataattacttttaaaagtttttcatttttgaagcatgagaaaaagtagataatccattggtgatacaataaaacacagtttgaatgtt

SEQ ID NO: 156250 - DNA, 2232 bp, Homo sapiens
  Payload ID: 10658
  Gene Symbol: MINA
  Gene Name: MYC induced nuclear antigen
  Uniprot ID: Q8IUF8
  ENST ID: ENST00000360258
  CDS Start-End: 214-1608
acaccggtgacgagcgcacggaaagtttggaggcttagcaaggagggtggtgccggcctccgcccggtggtggcagaactgcctgtgcgagcacggcttccacgtgggctgcgccgccgggcgtcatgtcgggcctaagagacacgctctacagctgtgaaatctgaagttcaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactctactcacgtgaccatcagcacctaccagaacaattcatggggagatttccttttggataccatctcggggcttgtatttgatactgcaaaggaagacgtggagttacggaccggcataccccggcagctgctcctggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaagctcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaa

SEQ ID NO: 156251 - DNA, 2341 bp, Homo sapiens
  Payload ID: 10658
  Gene Symbol: MINA
  Gene Name: MYC induced nuclear antigen
  Uniprot ID: Q8IUF8
  ENST ID: ENST00000394198
  CDS Start-End: 111-1508
acgctgccccgcctccagccgctgcgccgcaacgcagtgggctcgcggccgcgagcaacaggccgtgccgggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactctactcacgtgaccatcagcacctaccagaacaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaagctcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttg

SEQ ID NO: 156252 - DNA, 591 bp, Homo sapiens
  Payload ID: 10658
  Gene Symbol: MINA
  Gene Name: MYC induced nuclear antigen
  ENST ID: ENST00000503097
  CDS Start-End: 1-84
accacattgtcctcacagtactgccggatcaagatcaatctgatgaagctcaagaaaagatggtgtacatctatcattccttaaagaatagtagagagacacacatgatgggaaatgaggaggaaacagaggtttgtttcaactgaaaacaaatgcctatcctgtgacttgggtggtggttgggaagaattgattatttttgatttacaggtaatatgctttttatggctgcactgtggacttaaccattttgcactactcacagagctcctgcatggggatgattaagtcagacatttctgtgatacatgcacaccagttttaagacatactagctgggacctgtagccttataggaatggtataatgtaaaacatttcaaattactaatatcacttactacataaattaggatgccttttatatagaagttggcatcttttatgttatctaattgtagtgtgtctaaaatactcatgaggggtatcaaaaataatgatgtatggagaataaatttacaggaaaatgctacttcaatgacataagtagtatacatatattttgacaaataaatttatcctttcagtttca

SEQ ID NO: 156253 - DNA, 664 bp, Homo sapiens
  Payload ID: 10658
  Gene Symbol: MINA
  Gene Name: MYC induced nuclear antigen
  ENST ID: ENST00000506099
  CDS Start-End: 328-664
gcttccaattcatttaccagcaaataattccgcaacgattggccgacagctgggttgtccaacaggttactgagaccaggttattcactgttttcaggaaggatagactgggaggaagaggatctgatttcgccactcattagctgtaaatctggtgcctcgggtttcatgtcactgggctcatctttgagcagaggaacctgatttactcagcttcttctgctggtactggtttttgcctcctggacatcaagctttgtaacctcatggtcacgaaaatacattgaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttt

SEQ ID NO: 156254 - DNA, 708 bp, Homo sapiens
  Payload ID: 10658
  Gene Symbol: MINA
  Gene Name: MYC induced nuclear antigen
  ENST ID: ENST00000507612
  CDS Start-End: 1-327
gaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactctactcacgtgaccatcagcacctaccagaacaagtaaacactgcctcccagctgcacatgctaggacagctctgagtcctggcctgcagcagccacattcaggagggatatgagggagttggcccctacctcctatgcaaaccccagggtttatgtcctttactgacttccacattcctttgatgtcccatgtatgtgactggtccctctggacttgcttctggggacatcatgaacctgactctgtaggatgtggggcattgcccaaatagagagtcacatagtttggaaagaaagagactagctgtgggtacatcagtgtgttagtgatgccaggctgggctcatactctctctctttttttttaatatgataaaatatatagaacataaaatataccattttaaaccattttaaa

SEQ ID NO: 156255 - DNA, 1225 bp, Homo sapiens
  Payload ID: 10658
  Gene Symbol: MINA
  Gene Name: MYC induced nuclear antigen
  Uniprot ID: Q8IUF8
  ENST ID: ENST00000514314
  CDS Start-End: 31-873
tccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactctactcacgtgaccatcagcacctaccagaacaatgatgctggagctagaatgagaagatgtgacttgagggccattgctccccagaaatgatcctgtgttttgagcctaatgctccttcaggtaccatgtaaagttcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgag

SEQ ID NO: 156256 - DNA, 3030 bp, Homo sapiens
  Payload ID: 10659
  Gene Symbol: MYCT1
  Gene Name: myc target 1
  Uniprot ID: Q8N699
  ENST ID: ENST00000367245
  CDS Start-End: 9-716
ttccttttatgcgaacacaagtatatgaggggttgtgtaaaaattatttttctcttgctgtactacaaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaagatgcattatatatattttaattaaaattaaaacttcagatatttgtggattacaatcctcatttacttccaatgtgactaaaaagagaaaaaaaatcactgtgtcactttaaagaaaaatcttctaagggatttggattttactttctttagaatgacaagtgaatcatattgacattttacaatcttagatttttctttttttttcttttgagacagggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaatttttttttaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactggagacttttaatgtatttctttaatttgaaatgttttgtggattgtgaaataaaaataaatttatgtc

SEQ ID NO: 156257 - DNA, 724 bp, Homo sapiens
  Payload ID: 10659
  Gene Symbol: MYCT1
  Gene Name: myc target 1
  ENST ID: ENST00000529453
  CDS Start-End: 7-210
ccttttatgcgaacacaagtatatgaggggttgtgtaaaaattatttttctcttgctgtactacaaagagatagaatcaaactgctttttttcgacatactggtttttctttctgtttttcttctctttcttctatttcttgtggatattatggctaataacacaacaagtttagggagtccatggccagaaaacttttgggggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaatttttttttaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccg

SEQ ID NO: 156258 - DNA, 2389 bp, Homo sapiens
  Payload ID: 10659
  Gene Symbol: MYCT1
  Gene Name: myc target 1
  ENST ID: ENST00000532295
  CDS Start-End: 1-650
aaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgaggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaatttttttttaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactgga

SEQ ID NO: 156259 - DNA, 2698 bp, Homo sapiens
  Payload ID: 10660
  Gene Symbol: MAZ
  Gene Name: MYC-associated zinc finger protein (purine-binding transcription factor)
  Uniprot ID: P56270
  ENST ID: ENST00000219782
  CDS Start-End: 107-1588
cgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctg

SEQ ID NO: 156260 - DNA, 2532 bp, Homo sapiens
  Payload ID: 10660
  Gene Symbol: MAZ
  Gene Name: MYC-associated zinc finger protein (purine-binding transcription factor)
  Uniprot ID: P56270
  ENST ID: ENST00000322945
  CDS Start-End: 166-1599
ctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctg

SEQ ID NO: 156261 - DNA, 2333 bp, Homo sapiens
  Payload ID: 10660
  Gene Symbol: MAZ
  Gene Name: MYC-associated zinc finger protein (purine-binding transcription factor)
  Uniprot ID: P56270
  ENST ID: ENST00000545521
  CDS Start-End: 40-1404
ccagggtgagcgcgagccacctccctccctccctccgccatggatcccagcaactggagcagcttcatcttccagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaat

SEQ ID NO: 156262 - DNA, 1464 bp, Homo sapiens
  Payload ID: 10660
  Gene Symbol: MAZ
  Gene Name: MYC-associated zinc finger protein (purine-binding transcription factor)
  ENST ID: ENST00000568544
  CDS Start-End: 334-570
aggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttcctttt

SEQ ID NO: 156263 - DNA, 1574 bp, Homo sapiens
  Payload ID: 10660
  Gene Symbol: MAZ
  Gene Name: MYC-associated zinc finger protein (purine-binding transcription factor)
  Uniprot ID: P56270
  ENST ID: ENST00000562337
  CDS Start-End: 153-671
gccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggacc

SEQ ID NO: 156264 - DNA, 599 bp, Homo sapiens
  Payload ID: 10660
  Gene Symbol: MAZ
  Gene Name: MYC-associated zinc finger protein (purine-binding transcription factor)
  ENST ID: ENST00000568411
  CDS Start-End: 1-589
cggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctgctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcct

SEQ ID NO: 156265 - DNA, 646 bp, Homo sapiens
  Payload ID: 10660
  Gene Symbol: MAZ
  Gene Name: MYC-associated zinc finger protein (purine-binding transcription factor)
  ENST ID: ENST00000563012
  CDS Start-End: 1-459
agcttctcccggtgtgcacggggcctcggccgcccgctaggccgtggggagggagggacgcgacggaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctc

SEQ ID NO: 156266 - DNA, 672 bp, Homo sapiens
  Payload ID: 10660
  Gene Symbol: MAZ
  Gene Name: MYC-associated zinc finger protein (purine-binding transcription factor)
  ENST ID: ENST00000561855
  CDS Start-End: 55-309
ggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatgg

SEQ ID NO: 156267 - DNA, 1461 bp, Homo sapiens
  Payload ID: 10660
  Gene Symbol: MAZ
  Gene Name: MYC-associated zinc finger protein (purine-binding transcription factor)
  ENST ID: ENST00000563402
  CDS Start-End: 132-692
ggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggacggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaa

SEQ ID NO: 156268 - DNA, 1593 bp, Homo sapiens
  Payload ID: 10660
  Gene Symbol: MAZ
  Gene Name: MYC-associated zinc finger protein (purine-binding transcription factor)
  ENST ID: ENST00000568282
  CDS Start-End: 239-523
gatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggcaaggcgtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcg

SEQ ID NO: 156269 - DNA, 635 bp, Homo sapiens
  Payload ID: 10660
  Gene Symbol: MAZ
  Gene Name: MYC-associated zinc finger protein (purine-binding transcription factor)
  ENST ID: ENST00000567444
  CDS Start-End: 1-609
gcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggc

SEQ ID NO: 156270 - DNA, 567 bp, Homo sapiens
  Payload ID: 10660
  Gene Symbol: MAZ
  Gene Name: MYC-associated zinc finger protein (purine-binding transcription factor)
  ENST ID: ENST00000569978
  CDS Start-End: 292-453
atttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagaga

SEQ ID NO: 156271 - DNA, 1455 bp, Homo sapiens
  Payload ID: 10660
  Gene Symbol: MAZ
  Gene Name: MYC-associated zinc finger protein (purine-binding transcription factor)
  ENST ID: ENST00000566906
  CDS Start-End: 132-686
ggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggacggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaa

SEQ ID NO: 156272 - DNA, 475 bp, Homo sapiens
  Payload ID: 10660
  Gene Symbol: MAZ
  Gene Name: MYC-associated zinc finger protein (purine-binding transcription factor)
  ENST ID: ENST00000562557
  CDS Start-End: 240-475
ctggggaaggggagccactcccagggcggagggaggaagcctctcccggttaccagggagcaaggggtggtcctttgtcgaggaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggc

SEQ ID NO: 156273 - DNA, 991 bp, Homo sapiens
  Payload ID: 10660
  Gene Symbol: MAZ
  Gene Name: MYC-associated zinc finger protein (purine-binding transcription factor)
  ENST ID: ENST00000616501
  CDS Start-End: 85-843
aaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatcggcgctgtgcaaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttagggg

SEQ ID NO: 156274 - DNA, 3186 bp, Homo sapiens
  Payload ID: 10661
  Gene Symbol: MYCBPAP
  Gene Name: MYCBP associated protein
  Uniprot ID: Q8TBZ2
  ENST ID: ENST00000323776
  CDS Start-End: 163-3117
tggtgacgtcacggcgctcgtcggcgccgcctgtggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcacatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacagcatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccgctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagagcctgcacagtgaggtccgtgggctgctggacaccctggtgactgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttct

SEQ ID NO: 156275 - DNA, 3102 bp, Homo sapiens
  Payload ID: 10661
  Gene Symbol: MYCBPAP
  Gene Name: MYCBP associated protein
  Uniprot ID: Q8TBZ2
  ENST ID: ENST00000436259
  CDS Start-End: 274-3102
tggtgacgtcacggcgctcgtcggcgccgcctgtggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcacatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacagcatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccgctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagagcctgcacagtgaggtgcatcctggcagatgcgttccttgggagaacaccatgcagggtgcattcccatcaactaccaggtgcggtggctcgtgcctgtaa

SEQ ID NO: 156276 - DNA, 753 bp, Homo sapiens
  Payload ID: 10661
  Gene Symbol: MYCBPAP
  Gene Name: MYCBP associated protein
  ENST ID: ENST00000458692
  CDS Start-End: 1-293
ggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagagcccagactggtcttgaactcctgggctcaagcgatctgcctgccttggcctcccaagatcttgcaactcttaatccattccttggcatgccattgcccatgggaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagaga

SEQ ID NO: 156277 - DNA, 947 bp, Homo sapiens
  Payload ID: 10661
  Gene Symbol: MYCBPAP
  Gene Name: MYCBP associated protein
  ENST ID: ENST00000452039
  CDS Start-End: 6-947
ggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtacacccagtctcagccctggcttcactgtctttcaactcatgggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaa

SEQ ID NO: 156278 - DNA, 1640 bp, Homo sapiens
  Payload ID: 10661
  Gene Symbol: MYCBPAP
  Gene Name: MYCBP associated protein
  ENST ID: ENST00000419930
  CDS Start-End: 57-326
cgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagggtggcatgcaggaggcaggatccccggactggatgaagtgcagaagagccaggaaagagtttaagggtagaagggccaggaattggggtccttgggaagaggaaagaatgaagtgttgaaaccagccaccttgatgggattatttggtagaggagggtcggggagcggggcaggcgtcacttaggattcctgctggaaaaacccagaagaaaggccttgcttggctagttctctttttgactgccttttcctaccacgtgcactttccagctggatgacacttatccagctcctttagcctggaaagaatcgctagatatgactgcttcctaccctctacagctttcttctggttgcacctgggagagccacagggcgtctgatagcggactgacttccatggacatgttctcacttgcaacccacccccttttgatcttttttggctgtttccatttatttatttttaaatttaatttttagctttttttttctgtgtgtgtgtgtgtgtgtgtgtgtgtgtgtgtgtgtgtttgtaaacagggctctcgctgtgttgccccagctagtgtcaaattcttggcctcaagcgatcctcctgcctcggcctcacagactgctaggattccaggcatggaccactgcgcccagcctatttttgtttactgagagctgattttgtgtggtactgtggctcaccagaagggtatcggtattaactgtgtgaccctggtcctcaagaaactcagtctaatgaacacctggaggagtaacctgacaaaggtagaaatacaaatgctgtgatgtaggtgcccatcgggcttaagggggctcagagcacctgagccagaccagggatggttgtaggggtacgtcttctgaagaaggtgacatctatggcagacaagaaaaaaaaggagaggtttgcttctctaggtctaggaagcagcatgagtttatggaactgtaaatgtgggaaccagaagaggctgcacaggtgggtaggtcaggggccagaccatgaaagggctttatgtactaggtcagaaagcctggatgtgctcttgcaggccctggggagacccagcctcagagttgtgaaagctcattgtgaggagaggggaccctcagaaaactaacaggagcttagtcgcttttcagtatggctttatgtttcttcacgtataaaagtccaacgttgagccgggcatggtggtgcacatctgcagtctcagctgctcaggaggctgtggcaggaggattgttccaggccaggagtttatgatcacacctgtgaatagccactgcattccagactgggcaacacagtgagacccccattattaaaaaaataaaagtccaatgctgttttatgaca

SEQ ID NO: 156279 - DNA, 3108 bp, Homo sapiens
  Payload ID: 10661
  Gene Symbol: MYCBPAP
  Gene Name: MYCBP associated protein
  ENST ID: ENST00000437498
  CDS Start-End: 1-2864
ggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcacatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacagcatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccgctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagagcctgcacagtgaggtgcatcctggcagatgcgttccttgggagaacaccatgcagggtgcattcccatcaactaccaggtgcggtggctcgtgcctgtaatcccagcactttgggaggccaaggtgggcagattgcctgagctcaggagttcaagaccagcctgggcaacatggtccgtgggctgctggacaccctggtgactgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttct

SEQ ID NO: 156280 - DNA, 467 bp, Homo sapiens
  Payload ID: 10661
  Gene Symbol: MYCBPAP
  Gene Name: MYCBP associated protein
  ENST ID: ENST00000488432
  CDS Start-End: 1-320
aggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccggtgaggcccagcgccagcccctgccccctcatgtgtgccctgcgtcaagggtccccaacccgcaggccgcacagcggcaggtccgtgggctgctggacaccctggtgactgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctacta

SEQ ID NO: 156281 - DNA, 427 bp, Homo sapiens
  Payload ID: 10661
  Gene Symbol: MYCBPAP
  Gene Name: MYCBP associated protein
  ENST ID: ENST00000477744
  CDS Start-End: 1-146
tgcacagtgaggtgaagggaagcgcccagcagccattcccctgcctcccacctgccttattcattccgttcagtctgcagacaataagtgcccactccatcatggtggaagcagagctgcttcaggaagggcatcctcgtgtgtgagacaggcctcatgaataaggaatgcgcctagcatgttaggtgatgagtacgacgggagagaagatagaccaggcagggaatggaggcacagaggcctcagtgaggaggtccgtgggctgctggacaccctggtgactgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctact

SEQ ID NO: 156282 - DNA, 702 bp, Homo sapiens
  Payload ID: 10661
  Gene Symbol: MYCBPAP
  Gene Name: MYCBP associated protein
  ENST ID: ENST00000485169
  CDS Start-End: 1-325
ggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaagaatggtgcccatgaccctgccaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagag

SEQ ID NO: 156283 - DNA, 4433 bp, Homo sapiens
  Payload ID: 10662
  Gene Symbol: MAATS1
  Gene Name: MYCBP-associated, testis expressed 1
  Uniprot ID: Q7Z4T9
  ENST ID: ENST00000273390
  CDS Start-End: 78-2381
gttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggcaatctgcccatcctgtgtattgacaagcatcaggattccaggaggattcttcctgattcaaagactgtcaaataggaaaaaagaaaacagtaaatgaacaaaaacatcaacatggagtccaagtaatgaatttatagaggaaaatgtatgctactctgaaaacaaagcttatgttagagaatatcttactgtaagaaacaaggaaaattgcagaaacatttgctgagtgtttttaataggagtcaaaaagaaagggtcttttcagaaactgaagtaggaaataataacagacaaggtcaaaaaatagatgcaggctgaaaagaaaaggaagtgggctaagatgggaaaaatataaaaagatttaaaatccagcaacaaaatttacacattcatttggatgcagtgaaaagggcagaaataccacagcagagaataaaattgataatgttggcaacacatttattaagtgatccaacatgggatgggaaggaatgggcaaagagattaaaatgacagaagttagctgtagatgacctatcccacagcaatcggagttcttgaagaagaaaccagaacaaataaaatagaaacaataatcagagtttaataattaattttctgagtttttttttaaaaaaactaattatacaaacttgaaagggttcaccttgccctagcaaaactaggattgggacacctttttttccccctgaggatcactgacaaaaaacactgcaccagtaaggaagcaactaaattttgttttgttctttgaaaaaggctaacctgagctaggtaaaggttatatcattcacttttgaaataaaccatcgagaacacaaaatgacaagtgagttaggttgggctgatgggatagaaggtgggaggggaatgctatacagctgggaacagcagactttctctgaagggccagatggtaactacattagggtttgcgggtctgatggtcgccatcataactgcatactcaactctgccgttgtagggtaagagcagcactcgatgacacagaaatgaatgcacatgactgtgttccagtaaaattttattttaattaaaatcaattcatgtttgaaaaaggatttaaagtagcttctaataaaggacatgtgtaatgaaacttaaaatatgatattttctttaaaaatctttatccttatgtagacttctaaaactatgttttgcatttagacagtcaaggaaaatacaagttgttatacaattctcattgactaattgaagtttactaggagaggaaaactttttcttgataccggcaatcttttacttataatggcttgagttaaaatgctccaacttttctaatttttgcttttgaaaataaaacacctatagtgacaataaaaacacacatttaaagccaa

SEQ ID NO: 156284 - DNA, 2712 bp, Homo sapiens
  Payload ID: 10662
  Gene Symbol: MAATS1
  Gene Name: MYCBP-associated, testis expressed 1
  ENST ID: ENST00000482927
  CDS Start-End: 64-231
gtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacggtaaggaccgccgcagaccttcctccgcgtccgtcgcctcctaggccagatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaac

SEQ ID NO: 156285 - DNA, 939 bp, Homo sapiens
  Payload ID: 10662
  Gene Symbol: MAATS1
  Gene Name: MYCBP-associated, testis expressed 1
  Uniprot ID: Q7Z4T9
  ENST ID: ENST00000463700
  CDS Start-End: 67-783
gacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtgagttggtaaatctcctgactattggcagatgacgatgctgataaccacgcatgctgttcaaatggcccatgtacaggcaattgtggtttacagtgttgctatataaagtgtcttagtacagcaacttcatagactcataatttttctgatacttctggtcaaataaagatactatctttttattgtga

SEQ ID NO: 156286 - DNA, 4356 bp, Homo sapiens
  Payload ID: 10662
  Gene Symbol: MAATS1
  Gene Name: MYCBP-associated, testis expressed 1
  ENST ID: ENST00000482573
  CDS Start-End: 78-221
gttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggcaatctgcccatcctgtgtattgacaagcatcaggattccaggaggattcttcctgattcaaagactgtcaaataggaaaaaagaaaacagtaaatgaacaaaaacatcaacatggagtccaagtaatgaatttatagaggaaaatgtatgctactctgaaaacaaagcttatgttagagaatatcttactgtaagaaacaaggaaaattgcagaaacatttgctgagtgtttttaataggagtcaaaaagaaagggtcttttcagaaactgaagtaggaaataataacagacaaggtcaaaaaatagatgcaggctgaaaagaaaaggaagtgggctaagatgggaaaaatataaaaagatttaaaatccagcaacaaaatttacacattcatttggatgcagtgaaaagggcagaaataccacagcagagaataaaattgataatgttggcaacacatttattaagtgatccaacatgggatgggaaggaatgggcaaagagattaaaatgacagaagttagctgtagatgacctatcccacagcaatcggagttcttgaagaagaaaccagaacaaataaaatagaaacaataatcagagtttaataattaattttctgagtttttttttaaaaaaactaattatacaaacttgaaagggttcaccttgccctagcaaaactaggattgggacacctttttttccccctgaggatcactgacaaaaaacactgcaccagtaaggaagcaactaaattttgttttgttctttgaaaaaggctaacctgagctaggtaaaggttatatcattcacttttgaaataaaccatcgagaacacaaaatgacaagtgagttaggttgggctgatgggatagaaggtgggaggggaatgctatacagctgggaacagcagactttctctgaagggccagatggtaactacattagggtttgcgggtctgatggtcgccatcataactgcatactcaactctgccgttgtagggtaagagcagcactcgatgacacagaaatgaatgcacatgactgtgttccagtaaaattttattttaattaaaatcaattcatgtttgaaaaaggatttaaagtagcttctaataaaggacatgtgtaatgaaacttaaaatatgatattttctttaaaaatctttatccttatgtagacttctaaaactatgttttgcatttagacagtcaaggaaaatacaagttgttatacaattctcattgactaattgaagtttactaggagaggaaaactttttcttgataccggcaatcttttacttataatggcttgagttaaaatgctccaacttttctaatttttgcttttgaaaataaaacacctatagtgacaataaaaacacacatttaaagccaa

SEQ ID NO: 156287 - DNA, 535 bp, Homo sapiens
  Payload ID: 10662
  Gene Symbol: MAATS1
  Gene Name: MYCBP-associated, testis expressed 1
  ENST ID: ENST00000498167
  CDS Start-End: 1-306
gaatggaagggacataaggagaaacacagagaagccctccggcagctcaccacatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaa

SEQ ID NO: 156288 - DNA, 2353 bp, Homo sapiens
  Payload ID: 10662
  Gene Symbol: MAATS1
  Gene Name: MYCBP-associated, testis expressed 1
  ENST ID: ENST00000475093
  CDS Start-End: 49-444
aggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacatttt

SEQ ID NO: 156289 - DNA, 2426 bp, Homo sapiens
  Payload ID: 10663
  Gene Symbol: MAG
  Gene Name: myelin associated glycoprotein
  Uniprot ID: P20916
  ENST ID: ENST00000361922
  CDS Start-End: 151-1899
cctagaccctggaaggcaggggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagtccaaagaggtttctaccctggaatctcactgagtgccccaggagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 156290 - DNA, 2390 bp, Homo sapiens
  Payload ID: 10663
  Gene Symbol: MAG
  Gene Name: myelin associated glycoprotein
  Uniprot ID: P20916
  ENST ID: ENST00000392213
  CDS Start-End: 160-2040
aagtgggggcctagaccctggaaggcaggggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 156291 - DNA, 2341 bp, Homo sapiens
  Payload ID: 10663
  Gene Symbol: MAG
  Gene Name: myelin associated glycoprotein
  Uniprot ID: P20916
  ENST ID: ENST00000537831
  CDS Start-End: 186-1991
gagctgggctggcggagcagaggtgcagaagcaactgagtccaagttgtctggcggcttcaggtggacccagaagacgtccccaactcagggagattcaggtaacggctgacaggtgctggggacctaaaggctttggcccctgagcaggttggagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 156292 - DNA, 559 bp, Homo sapiens
  Payload ID: 10663
  Gene Symbol: MAG
  Gene Name: myelin associated glycoprotein
  ENST ID: ENST00000600291
  CDS Start-End: 166-559
aagtgggggcctagaccctggaaggcaggggactgcgagctgggctggcggagcagaggtgcagaagcaactgagtccaagttgtctggcggcttcaggtggacccagaagacgtccccaactcagggagattcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggagg

SEQ ID NO: 156293 - DNA, 585 bp, Homo sapiens
  Payload ID: 10663
  Gene Symbol: MAG
  Gene Name: myelin associated glycoprotein
  ENST ID: ENST00000595791
  CDS Start-End: 111-585
actgcgagctgggctggcggagcagaggtgcagaagcaactgagtccaagtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagct

SEQ ID NO: 156294 - DNA, 542 bp, Homo sapiens
  Payload ID: 10663
  Gene Symbol: MAG
  Gene Name: myelin associated glycoprotein
  ENST ID: ENST00000597035
  CDS Start-End: 124-300
gagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctgacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcct

SEQ ID NO: 156295 - DNA, 575 bp, Homo sapiens
  Payload ID: 10664
  Gene Symbol: MBP
  Gene Name: myelin basic protein
  ENST ID: ENST00000354542
  CDS Start-End: 254-475
agatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaagggaggaagagatagtcgctctggatcacccatggctagacgctgaaaacccacctggttccggaatcctgtcctcagcttcttaatataactgccttaaaactttaatcccacttgcccctgttacctaattagagcagatgacc

SEQ ID NO: 156296 - DNA, 2772 bp, Homo sapiens
  Payload ID: 10664
  Gene Symbol: MBP
  Gene Name: myelin basic protein
  Uniprot ID: P02686
  ENST ID: ENST00000355994
  CDS Start-End: 265-1179
tgggtgcgcgcccgtccctcggagccgccgccgtcagtcaccgccgccgcgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggt

SEQ ID NO: 156297 - DNA, 1255 bp, Homo sapiens
  Payload ID: 10664
  Gene Symbol: MBP
  Gene Name: myelin basic protein
  Uniprot ID: P02686
  ENST ID: ENST00000359645
  CDS Start-End: 35-595
agacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctg

SEQ ID NO: 156298 - DNA, 2281 bp, Homo sapiens
  Payload ID: 10664
  Gene Symbol: MBP
  Gene Name: myelin basic protein
  Uniprot ID: P02686
  ENST ID: ENST00000382582
  CDS Start-End: 88-681
aacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtatttgca

SEQ ID NO: 156299 - DNA, 4844 bp, Homo sapiens
  Payload ID: 10664
  Gene Symbol: MBP
  Gene Name: myelin basic protein
  Uniprot ID: P02686
  ENST ID: ENST00000397860
  CDS Start-End: 216-809
cgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcaaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaa

SEQ ID NO: 156300 - DNA, 4800 bp, Homo sapiens
  Payload ID: 10664
  Gene Symbol: MBP
  Gene Name: myelin basic protein
  Uniprot ID: P02686
  ENST ID: ENST00000397863
  CDS Start-End: 172-765
tcctttcgcgtccacctgagcccccccgttttggaaggtggagtggggcttgggaaaaggttcaagcgtctttggggacccccgtgcgactctggctggaaacaggcgagctctggttccttgttccgttttccaattgcaacaaccctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcaaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaa

SEQ ID NO: 156301 - DNA, 2127 bp, Homo sapiens
  Payload ID: 10664
  Gene Symbol: MBP
  Gene Name: myelin basic protein
  Uniprot ID: P02686
  ENST ID: ENST00000397865
  CDS Start-End: 79-561
aaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatatt

SEQ ID NO: 156302 - DNA, 2145 bp, Homo sapiens
  Payload ID: 10664
  Gene Symbol: MBP
  Gene Name: myelin basic protein
  Uniprot ID: P02686
  ENST ID: ENST00000397866
  CDS Start-End: 55-570
gagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaa

SEQ ID NO: 156303 - DNA, 884 bp, Homo sapiens
  Payload ID: 10664
  Gene Symbol: MBP
  Gene Name: myelin basic protein
  ENST ID: ENST00000397869
  CDS Start-End: 48-758
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtg

SEQ ID NO: 156304 - DNA, 2168 bp, Homo sapiens
  Payload ID: 10664
  Gene Symbol: MBP
  Gene Name: myelin basic protein
  ENST ID: ENST00000397875
  CDS Start-End: 48-593
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacatttgcagcccacggttctctgtgtctttccaggtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaa

SEQ ID NO: 156305 - DNA, 569 bp, Homo sapiens
  Payload ID: 10664
  Gene Symbol: MBP
  Gene Name: myelin basic protein
  ENST ID: ENST00000447114
  CDS Start-End: 266-569
gctcttccttccatcatccatcatctgcacatgccttcttctctccctgtcgtccttcatcctccaccccccgctcactcctcctcactctgggctcttgccaagccagctctagaggagatttgctggaggactttggggcattgccggcggcgcccacccggactcacgcagcccactctgtgtcccccggcaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgg

SEQ ID NO: 156306 - DNA, 566 bp, Homo sapiens
  Payload ID: 10664
  Gene Symbol: MBP
  Gene Name: myelin basic protein
  ENST ID: ENST00000527975
  CDS Start-End: 51-149
tccagaccatccaagaagacagtgcagccacctccgagagcctggatgtgatggcgtcacagaagagaccctcccagaggcacggatccaagtacctggccacagcaagtaccatggaccatgccaggcatggcttcctcccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcag

SEQ ID NO: 156307 - DNA, 581 bp, Homo sapiens
  Payload ID: 10664
  Gene Symbol: MBP
  Gene Name: myelin basic protein
  ENST ID: ENST00000531144
  CDS Start-End: 58-237
gacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattaga

SEQ ID NO: 156308 - DNA, 558 bp, Homo sapiens
  Payload ID: 10664
  Gene Symbol: MBP
  Gene Name: myelin basic protein
  ENST ID: ENST00000473302
  CDS Start-End: 48-344
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgcaggagcccgttaggaaatggacggcggcacagggctcccagtgcagcccacggttctctgtgtctttccaggtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgat

SEQ ID NO: 156309 - DNA, 582 bp, Homo sapiens
  Payload ID: 10664
  Gene Symbol: MBP
  Gene Name: myelin basic protein
  ENST ID: ENST00000533278
  CDS Start-End: 58-252
gacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccct

SEQ ID NO: 156310 - DNA, 582 bp, Homo sapiens
  Payload ID: 10664
  Gene Symbol: MBP
  Gene Name: myelin basic protein
  ENST ID: ENST00000527041
  CDS Start-End: 58-384
gacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaa

SEQ ID NO: 156311 - DNA, 569 bp, Homo sapiens
  Payload ID: 10664
  Gene Symbol: MBP
  Gene Name: myelin basic protein
  ENST ID: ENST00000459948
  CDS Start-End: 54-413
agctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtctatacttcttcaccaactaggacagaagtggggaggctgggcacccgggtgcttctggcagctgatggatgctagccaccctcagcaggcaggagcccgttaggaaatggacggcggcacagggctcccagtgcagcccacggttctctgtgtctttccaggtgacgcctcgcacaccacccccgtcgcagggaaaggggagaggactgtccctgagcagatttagctggg

SEQ ID NO: 156312 - DNA, 581 bp, Homo sapiens
  Payload ID: 10664
  Gene Symbol: MBP
  Gene Name: myelin basic protein
  ENST ID: ENST00000526111
  CDS Start-End: 58-507
gacgagctccagaccatccaagaagacagtgcagccacctccgagagcctggatgtgatggcgtcacagaagagaccctcccagaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgccc

SEQ ID NO: 156313 - DNA, 584 bp, Homo sapiens
  Payload ID: 10664
  Gene Symbol: MBP
  Gene Name: myelin basic protein
  ENST ID: ENST00000528160
  CDS Start-End: 55-261
gagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgc

SEQ ID NO: 156314 - DNA, 580 bp, Homo sapiens
  Payload ID: 10664
  Gene Symbol: MBP
  Gene Name: myelin basic protein
  ENST ID: ENST00000493623
  CDS Start-End: 48-374
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgacagaagtggggaggctgggcacccgggtgcttctggcagctgatggatgctagccaccctcagcaggcaggagcccgttaggaaatggacggcggcacagggctcccagtgcagcccacggttctctgtgtctttccaggtgacgcctcgcacaccacccccgtcgcagggaaaggggagaggactgtccctgagcagatttagctggggggccgaaggccagagaccaggatttggctacggaggcag

SEQ ID NO: 156315 - DNA, 875 bp, Homo sapiens
  Payload ID: 10664
  Gene Symbol: MBP
  Gene Name: myelin basic protein
  ENST ID: ENST00000498683
  CDS Start-End: 617-875
caattctaaatgccccacttctttcatgcatgaattgcaaaaagatgtggcaagttttgtttctaccaagaaaactaaaaacaccttttgtcaaataaatgctccttgcatatttaacttatgcaccagtggccttttaaacagtcaatgtcccatcaaggtgcctgcacatctgggctctccgggagcagccatggcagcacccgggaagaaacgctgatgtggctgctctgcatgctcagatgacttcatcgggaagcctgggtgcattttacgctgggtgccaaatctcgagtaactgaggaattcccagagccttctgaaacacagagctgcaataaggctgctccatccaggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccg

SEQ ID NO: 156316 - DNA, 568 bp, Homo sapiens
  Payload ID: 10664
  Gene Symbol: MBP
  Gene Name: myelin basic protein
  ENST ID: ENST00000483025
  CDS Start-End: 48-248
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggagagccgcacactgagtcggtgatagaaatctctccccagcaagtcgcacacccaaacccgctgctgccagcccgtagctgccccaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggag

SEQ ID NO: 156317 - DNA, 915 bp, Homo sapiens
  Payload ID: 10664
  Gene Symbol: MBP
  Gene Name: myelin basic protein
  Uniprot ID: P02686
  ENST ID: ENST00000580402
  CDS Start-End: 1-915
atgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 156318 - DNA, 563 bp, Homo sapiens
  Payload ID: 10664
  Gene Symbol: MBP
  Gene Name: myelin basic protein
  ENST ID: ENST00000581878
  CDS Start-End: 86-563
ttgcattcccaccggcggtgtgtgagtgattcaggaccttcccagcctgggcagcatttgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggc

SEQ ID NO: 156319 - DNA, 9797 bp, Homo sapiens
  Payload ID: 10664
  Gene Symbol: MBP
  Gene Name: myelin basic protein
  ENST ID: ENST00000585201
  CDS Start-End: 1-542
ccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaaggtctggtctcttgcttctgtgccggggacccagccctgcaaggccagatcctcttctcccagagggttcccaggcgacgtgactggtctccctcccagggagggagcaacaccacgtccgagaaaatgtttaacttcctccaacacaaccagtgcgagaagccccaggaacccgcatgtggaagtgggactggctggcccgtctcagtgaccccagatgctgacactgggaaaatgattctgctgatgaacagaaaaagaggctaaatagagttgctcgatttataataacctcattaatccaaagatttttgttttgtatgtgtttaaataataattaaaacatagatatcaagccatccagaaaatcttccttaggaattttaggctggttaatactgaaagcaaactttcaaggaaggtttaaaatggccaatttgaactttctagtgaaaaaatttggtgtctgagccaaattaaaatgccaatcattatattctaaccaaacttacagactttagttactagcaaataccagatatgattcttactgtataaaagttataattttagaataaaatggaggaataaccaccaacgtattgtagataggttgtgtctgtctccgaaactgcaatgctctcatacgctagaacagagcctacctacactttctgctcaattaataagcatcatataaatgaatgaatacattttaaaagaaaaacaacaaggagaaagaacaggaagaaagaacagggaaagaaaacagaaggtggggaagaggaaggaagagagggaggaaggggcagggtacttgagagaccatgaggatcccagatcagtcccacacatgattacactgaattatgaactaagatatttaccgaaacgttttccattaatgcatatttgacttgctttttctgacctaatgaatttgcaaaacgatgacaatcatgtagcaaatgtacatggactagtactcacaattaattttttattttctatgccagcaggagacaaagatgatagaagaatgaaattcatttttgacccagaaatcttattttagctactgctttatctgctcttaattttctaggagtggactttggggccgtcgtgccggatcctccctgaatgtggagcgatggggggttgcacacaggccgttctgccccagcagctaacaagaaagacccttgcattcctccctgcatctctcccttttgggtcctactaatgtctgttgaatttctcttttttccaaagcaaaatccttctctgcattttgtctgcttgtctgtttcccagagccgcaggactctctccttgtctggagttccagagagcccccactttctctttctaagctgtgttgtgtgtttcctggtacattctaggttccccaaagataaacatgactaaggattggaaaggaggaaaggccgcgcagattgttaatctgaaagtcaatccccggatttagctctcaaaaatgctttatttttggagaaaagcaatagagtaagacagaaggacttaacgcttgcagggaagtggctttctgccatgtagagccaggctggcaacctgccctctgccatcagggagtgagcatgaacctggaaacctctaggacgcaagagcgaggctggctgtcccctcgtgtgcagtgcttagaccttcttgccacacatcccgtccctcacctcactggatagcccccgaatcaactgttcacacgaaagcagctgcctggttctgagtggccatgctcactcccaagcacaggctgaatgaaaagaaaactgtgcaagtagcttgtatggtgggaagcccccagcagaggctgagggtgcagccaggtgctctggaagccttgaggcctctggtgtcatcttcctcacctctaaataagagatgggctaggttggtcaaggtcctccctgtcctaaaacactttaatgaaatggaagaaaggctgcaggctgatagaggagggacagtctggtttggttccctcaagtcttcaggagagggctcaaggacagtctcccatttcttgttggcaaaatgtaaagtgcagtctggaccctgtccattgagtagagactcaggaggccaaccaagatccctgaaaagctaacagcgtggtcagccttcccacagacagtgcacccaccgtgggaggacacttcgccccccattgttaacgtccaccgcgcccagactcccacagcgagctccttcccttcctccccatgtttgcagtggagttcccactcgagaagacagcacagtagcaagtagaggctggtcctgggacactcgcacccatgtgtgtcaggaagcccctgcggtcacacggcccatgaggaagccagaggggctgctggggctgatgaggccagggcagggcggcctgctcttccataaatgacagctggcaccaaagcccagagctggcagcctccacctgaggagtggcatctccatgaacggcttgtgttctcgcacagccccattgcgtagatgaggaaactgaagctcagagaggttcctgcccttgcccaaggccacacagccggatgagctagaaaggtgctaggggactgggaggtgggggagctgagacgctgtcccgctgctgccaggatgcggccgccccccgtgccagccaggcctgcctcctccctctgtccggctcagcagccccggcctcctgttgctcccagtccgagctatggccaagggagactgattcctgctcaccctgggagagagctcaggattttgtctcaaaaccttataaaagatacgaggctcgacattttactaaggccgaggactcttgatctcccagacagatcctagaaccacagggcacatgtgaccagaatccaatctgtgcaaatcaatcagcaaaaggagcccccagcaaaggcgcaggccggggcctccggggaccggcacctacacagcgcacagccccccagggtccgagtcctccaaacccgtgtaggcaggagcctccttaccttgatttgcttgatgtttgctaatcttctcttgaacaccccacagcgtgaaggtaagcaactgttccctaaacgacttagatccttaaaatatgtgtggttgggccgcatatctcatgagagagcctccgcccaaaccagagccctcctctctctgcggccaacaccctggtagacctgggggagcagcctctcccgcccccaccccctcagcgtggtgctggcccgtggctcctgaaccactcaccagtccagtccggggcctgggcccttccccggggccctggtggcagctcccagtggctcaagcagcgtgcccagcaccgcgggtggaggttgagctccgtggtcttctcttgcagggggccgaaggccagagaccaggatttggctacggaggcagagcgtccgactataaatcggctcacaagggattcaagggagtcgatgcccagggcacgctttccaaaatttttaagctggtaaggtaccctctgctcagctccactgagcggggactaagggctcccagaatccccaactaagctgagtacaagggtggctgccgcctctggctcagccgcactgtaccctggacgtgctctgtcccagcaggcgtgcaggggctcaggtggcattgcccacccgcatttacgcgtggatttcctccgagatgcatgtgaagccggaggtgcttgaggaagggctgcgcctgggctggttcaggggccctggagcaggcgactgaccttgactctggggcagggcccagctggagtccaacttgctcatgcccaggggttggggccctcagggagctaaagcaggagtcaagcagacgtgggtgtcggggggagatccctggagccacgggagggaatgcccaggagacctccagggagtggggagtgtcccgtcggctcatgaggacctggaaccagacccaggacgaatgccaggcccgctgtttataagctctgtctctgagacttggttttctcatctgtaaaatggaggtaacccgcccactcagctcacaaaatcgctgtgaaagtaaaaggtagtgacaaacacaaaacgcggctggcaggtgcgcggctcggattccttagataagcagtcacctttattattgttaaacgtcacccagaaaacccttaactcttagacagcggctctcattaagcaaaaggggaggcacatgaagctccaggcagggccgggagggaaccgtgaagccaaaggctctgggagcccccaggcacctgcgtttgcattttcatcctggaggagaccaggcttctggggctgctccccggggtgcagagaggaggggtctttcttggtgtgtaacatactcattgattcagtcacctgacctttgactccatgtattttgttgagtctggatgtgtggtgtgctctgcccagcagcggggatccacatgagcacagacatggtccccccgcgtccttggtgagtgcagaacctctgccgtgagcctcgattctgggaggttctgggaggttctgtggacaacaggcaattcagggcacagcccctgctcttaaggatagccggtcttaggagaagcttttaatatgtgaagtgagcagggagtaactgagctgctaagtaagcagctttatgtcagatgaagtggtaggcaggatccactcctcaacgtaaattctgagttaagaaaaaaattctccaaatattcaagtctcagggccatcatgctgtacattgccgcagttctgggatgtggccacaagagggcggagatgaggctccccggggagcagtgtctgaacccagcactgcagtcaggacggccccgccccacctggccagcacgtcacctgcctctgaatcgcctgggatgcacgcccagacccctatctgcgctccgccacagcctcactgagtcagaatgtccaagggcgaactaggtgttgctagttgtgatgattttgcagacaccgtgctcacctgggaaacacggattcatcccatctggaaaactaattactccactaccagcttaaggactgttagacacaccgggagagctgagtgctggctcagagttgatgggagggcccagatgagtgaggggccccatttagcaaatattgtccttgcaatatatgcaaggcttacaaccagtcactcaaagatgcttgcaaggccagagcttaccaagaccaccctgaggaacagaaagctgcatttagatctgcacatttactgtgtgcaaatataaccagtgtactatacacatgtgtttcctgaaataagttcagtattttccctgaacttttttgtaagaagcttttaaaaattatttaatttctgtagagttcaagggaagcttctatgtatcaaagcaaatttcaaatcatatggttgtaattaaattttactgcataaaaagttcataactggcctactatggccatatggctgaattagttgacttggagcacttccaatagattaataaatcagctcccccagaaatgagggggtctagaggcaggcagatggagaggacagggacttcatagcatttaacatcattttaccatctttccttcctgttctttttggtgctgttggaaatcagtagtgagaggaaaacactcaaatctggaagtctagcgctgtcggtaggaactgggtagaaaaaactatgcatgtccccccatcactcggaaactacatcagaacatcataggagcatcctgtttccatgtgcattagtttccacgaacatacatgtgaatgttttcccacctgtagtgttgctgtggagttgtgagatgtcaaagtggaggcaagagtatctgccttttgcagtaggctctgttcttttcctgtcctgagagaggaggtcagtctaaccctcaccttgtgagttcagccttatactgacctgagcccagggtggatcagatgctgagatcatgtgactccaagttgcaagacacgtaatagagagaagcgtgactgttgcatccatgcaggctctaatcctggctccttcgggctggctgagctttggctcctgagctataaagagaggatgataggaacacctactccaggaggtgctgtgagcacaaaagagaaaacggggaaaaacgggtttcctgcatggtcagtgctcaacaaattgtagtttcaatgataaaaagtaaaaccaatacacccaccattttcaatgtcaaaagggggcatcaagaaagttaagattgtacctcggtaggttaccttgccagaggctgcagggaacttactccatttcagcacagaagcactttgtttcataggacagtggttctaccactttccaggaagtccaaaggctgatctcttggaaatgcagcaaaaggtgaggtgagtgccaacttctgggctactccagagggcagctccaatgccagagatgttcaagttaagccaggatcaaacaggaaaaacccacgctcccgagggagaggctggccctcgaggggcagggccctgcacctgtcagtccccaggccggcaggaggcctccacggtatgtgagaaagctgcctgtcttgggagggaaatctcactagatggttcctgaagcggcttcgcaggctagcatttcataaacgttttcacttgtgaaaacaaaaatcccttgagtgagttgtgtaagcacaacatagaggcttgtttataatgctacgtatgtacttggaaaaccccccaagaagtcagaactgtcaccttggtctgttagctgcgttacttggaaggattcttggcgtctgcgctctggttatttgtgttactgggcagtgtggaagacgtagaattagatgaggacagtgttggttcgttgctgatcggccacggtaaagagcatatttcttttctatcttgctttctgggggctcttcgccaaaattgatcatttcataaaagaggggaaacccaaggagagagactaaactttgaataaaaatttgaatgcaaaaaaagtgcagttctgcttcgtcgatctaagtgacattctgagtgaccaacgcattcctctttctagagggatggccacgcctggctacctccacaccgtgggccacagcacacctgtgcaccatctcaattagctgccaactctcttttaaacatcgaaattatttgtcccccaaacgtgtaaatgcatggttttaagaccccttcaagtcaaagtttgcagacaaagctctctgtgcatttgatttgtctggtgtggcagatgagatggcacataggagggacgtccccagggatggacacgtggctttgctctttgctggcgcgtgtagcaaggggtgtgctagggtcccgccgaaaaagaagttgctcctgttgtcgctggcagttcccctcggctgccctggcacctctagctgacgagaaaaagtgctcattcaaagcaaagcaatggagcggctgcactttcacccacagaagtgcagcgttgttttgcagagcagtggttatgccaggcaccactccctggggcctgggaatccgattccagttctctctcacagaactggaaattcaattagcatttgctgagggaggtcgggagaaatggaatgaaaagaccagctctccggggtgccatttctattagcagatgagagagacacccaatggctcagcatccacccgggaccacagaagaggggatgctggtgtgggaggaccctgcggcactctcgtcctaactcctctctcttccttttcagggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatgg

SEQ ID NO: 156320 - DNA, 570 bp, Homo sapiens
  Payload ID: 10664
  Gene Symbol: MBP
  Gene Name: myelin basic protein
  ENST ID: ENST00000583474
  CDS Start-End: 48-227
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggcgtgaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacc

SEQ ID NO: 156321 - DNA, 552 bp, Homo sapiens
  Payload ID: 10664
  Gene Symbol: MBP
  Gene Name: myelin basic protein
  ENST ID: ENST00000577755
  CDS Start-End: 1-181
acagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatg

SEQ ID NO: 156322 - DNA, 561 bp, Homo sapiens
  Payload ID: 10664
  Gene Symbol: MBP
  Gene Name: myelin basic protein
  ENST ID: ENST00000578873
  CDS Start-End: 48-561
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcgg

SEQ ID NO: 156323 - DNA, 573 bp, Homo sapiens
  Payload ID: 10664
  Gene Symbol: MBP
  Gene Name: myelin basic protein
  ENST ID: ENST00000583798
  CDS Start-End: 449-573
ctactttttaattggattgtttggttttaacaactgagttttcctaattctttatattttctagatgctggccttaccactcggtgattattttctaccactttatcttgttttttcaccctcttcacagagtcctttgcagaaagttttacattttgttgaattcaagtttattaattttaccttttttggattttgatttttggtgtgaagtctaagtcttcacctagcctgaggttcccgaagattttctccttttttccctacaaattttatagtttcacattttatacttaagcctattttccattttgagttaatttttgtatgaggtgtgaggtttaggttgaggcttatttgttttggtttggtttgggttttgccaacgaatgtccaatagctccgggactattagttgaaaagcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagagga

SEQ ID NO: 156324 - DNA, 578 bp, Homo sapiens
  Payload ID: 10664
  Gene Symbol: MBP
  Gene Name: myelin basic protein
  ENST ID: ENST00000578193
  CDS Start-End: 48-521
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgtagtgagaggaaaacactcaaatctggaagtctagcgctgtcgggaggaagagatagtcg

SEQ ID NO: 156325 - DNA, 1052 bp, Homo sapiens
  Payload ID: 10664
  Gene Symbol: MBP
  Gene Name: myelin basic protein
  ENST ID: ENST00000579129
  CDS Start-End: 291-1052
agcccggggaggcggggccggggagctgggtgcgcgcccgtccctcggagccgccgccgtcagtcaccgccgccgcgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggaggaagagatagtcgctctggatcacccatggctagacgctga

SEQ ID NO: 156326 - DNA, 2958 bp, Homo sapiens
  Payload ID: 10665
  Gene Symbol: MYEF2
  Gene Name: myelin expression factor 2
  ENST ID: ENST00000267836
  CDS Start-End: 117-1847
actgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggta

SEQ ID NO: 156327 - DNA, 10360 bp, Homo sapiens
  Payload ID: 10665
  Gene Symbol: MYEF2
  Gene Name: myelin expression factor 2
  ENST ID: ENST00000324324
  CDS Start-End: 281-2083
aggactggtccagccctcccaggcaggtgtagggccgactgcagcaacagcggccctgaccccagctcccatggctcccctccccccgcactcccaccccccgcacccggcacacaccatctcccagtcacccagtctcgaccggttctcgcgagatccgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggcagtgcaatgattggagggtttgcaggaagaataggatcttctaacatgggtccagtaggatctggaataagtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttgatttcatttataagatctcttgaattgtaccccaggctaaataacagtggaaaatacagtttatatataatatgcaactcacaaactccagtgatcttgttatagtaatacttaatcattttgtaaatggtactaatcttcaatcttgctgaaaagaaatttgctgtgtagctagactactttgagtgaacatatgcaatttgttcttatatgaatattttcaagttgtgctattgtacttaaaatacataccagttattgtgaccatccaaaccaggatatatgtaaatgcggatatccatattgcagacatgaaaaaggttatcacaaagtagtttttccaaaacttttttctacaatctggtgtggttagaaaaagtaatgtaataataggaagggataatacccaaaaaattctttttaagtctgcttcaggcatgttgaaaacacttggtggatctgttgtggaaaaagtaaacacttttgagttttctcaaatggctaattaagttagaaatgcctatttagaaagttatattgaaataaattagctgtatcagtttttaaaaggctgtttaaaacatttgagtacctcattactgatattgctggtgaaaagaaactaattgaaactttagggcagacaatgtaagatgtgatactccgcatttctttatttggggccttaaatctataaaaatgtcttgggccattcgttaaatatattgtagatagtgtttatgaagtgtcaattggacatctcctgtggattgtcttcagtaactttttgcttaagggattaacctggtttctaacctagctactccagttgtctccacttcataatattgatgatgcctctgcctgccctatgtaccagataatgtatacttaaagaatataaaataatcatagcataatttttttattaagtcgcatatcctaattcttagtggaagtggtttttttgtcctatttcattactattttatttattaaattcagactttaccacagttcatagaaataaccttaaagtaggaggtagtatatcatctaaagtacaatttatgaaaattgagtatatttctttattcaatttaatttagtagaaggataatgataatatattggataaaaattcgaattcaaaaatgttcaaaatttgtatggcatttacaaaataatgtaacaattggatgaaatcatgttaaaactaatgttagtacaacaactcataaaaagtttgccaagcttcaaccaatgtgccattaagtaatattagatataattttaacataatcaaagaatttggattggttcttttgcgtttcttattataaacttaatttggagaggcatacctcttatacctgaaagagtagaagctaaaatttttgtaaaaagggggaaaagtcatgttttaaaattttaagtagtagattagaataaaaccctcctaaaggcttaattaaatttagaatctgttttggacaaccactttataaaaaggtaacccatgaacttataattttgaccatagctgaattttctgacttcctactgaacctatttacctaaaagttttgctattgctttaaacaatggtaaacctcagctgtttttcttctttcttccaaaccagcccctttttctgagttcccagttttaataagtgctgttcccattttctcagtcaagattaaaacataggaggtgtctttgttcctttttctggccccatatagtcttggtgatgcttccttcatatagtctcacatctgttctcatttattcccaccactttcacttggtctaggcacctagtaaacacatcagctgttgtaatagcctctcttacagacctctttgtctcttcatattttagttcggtgaacatcattttgggtaacattactaagataacagttctaataatttctctcctcagaaaccttccaagattcttaaaatagcatttaagattcttcttatcctattcctttctacctttcctctccttccttcctatgcacatactgtgctctatgtgttttatctctgcatcatttatggaatgaagacctcagtagctgctacttattggtcataacatatgtcattagttaaagtctttcctgtccagcaaggcccaatttaaatgctcccttctctgtgaaaatctcctatctgtcctcaccacattttggcaatctgtcccatttgtgaaccacagtcacactttatttttctctttttatggtacttaacgttcatactttagctattttgtatttcctgtgatattggaagttccttaaaggtagggacttggtctttatcatttctgagtcttcacagtcttttttacataaaaagcacacaatacttgctgaattgaaatgaaattttaaagtttttcctttgcgaatagacttaataatgggcaagatttagtgattaccttcagaaacctgactaaggccatgtaaacttatagagagctgagagtagccagaatcttcataaaatattccactatcagttcttgattgccgacgaatgaatggttgaccttcatcttcccagcccatcagtggctgttgttcacttctctccatagctttggcaagacaggcgcagcaaggactgcatttctttataatatattggttaattttaatgtcaaaacacagcaccaaaacatacaatccatatatcaaaagcagtaaagccccttcatacctacaaaagagaaatttgtgtttttaaattaaaagtgaaagtcattttagagttgatagcttttgggcagtatctattgaatgattttctaacaaaagtagccatagaacaatcaaacatttctagatattttttgttttgtagatttgtccagacttgattacagcattattatgtttattgataaaagctggacacttctgtgttgtttttttttttttaaaaacaagatcaacaaactcgtttttacttgtagattccttccaaatgataggtataaaaatgcaaggaaaatgataattggagattttcaaaataaatgtaaaattaataaatagtggtgaacattttctgcctcagctcattggcataatacattccccaacatacataataattataaaataatatagtaactgttaagttatttcaactgtccaagttttctggtataggaactttgtgtaaaatattactcagatatgggaggcttaggctgggatttttcagtttgtcatacagagcatttttaatgatttgaatgtagctgaatttggcttacagtcacaagaaaacaagatgttctaaaatataaaattatacccttggaaccaagaactgtttccctgtactctggcagttagctaatgccatcacatttgaaccttgcatttaccttttatagccagtgaatctctgtctgctgtatcttaaagaacagttctgatttccctaatggaggaagaattagcttggatactctcacagtcactatcccttacagacaactgctgagttctagaaggatttctattctaccaacacagtgtcttagggagacggactagaggacaggatgattagtttagaaattatgcttctggctaggttttaagtttcttgatagcaggtattacgccgtgctgcaaggttatggttctccagatggacaccattacattttttttttttcatatttttctggtgtcctctggagttatgcaatgtatataacctgtgtagctgtgttttacatttcattatcccttatgatatctagcatagtgagaaggacctagtaggtgcctgctgcttactagttgaaaaagttagtatctgtccactcagtcaccacctttttcattttcttggaccagctaggcacagagagattgtaaggaaagcaaacaatttttaatatgaaaagctaagcattgttatttcttagaggaaggctatagtttctcctgaatgagcatcagaagtttggaggaatttaaaaagacttcttttacttcctctaccatccttctccagtcttttgtggccatgaacacttctaaccaaggcaaggtgagcagtaacccagcagaagaaaaagtcaactgttgtggctttaatggacaacaggagttgggaaactttctgaataggcagccagtggggagaaggaaaagtggtggtctccagtgactagtgagagaaaaaaggagactgtgaagtgattaagaagaaattgcaaactagtgagaagaactcaatcagcaattgtgatgaggttaactcacagacctgttggaatatggtatagaagtggcagattaagtgactgaaataacatttctgaaaaaaaattactgaaccatcagaaattcataaaatctctaatttttacataagaattattttcaagcttaccagtaaacttggttgtcatatattataccaagaactgctgctgcactaattgtgtacgctgcacagtctctgaataggggccaacatgatagtgttgagacctgtaatatggtaagttattatttccattacattgtaacttcttcaagtacaatccttagtataatactaaaattgtttatatatttgtagttaaatattgttatcttttgcatattgcttagagaaaaaaatgtaaaattgtgttctaacttacacagactttcataaatctgaccaagagctatttgtggattaacattaaattgaatacatgttgtttttctactgattaataaatttgattgcacatat

SEQ ID NO: 156328 - DNA, 736 bp, Homo sapiens
  Payload ID: 10665
  Gene Symbol: MYEF2
  Gene Name: myelin expression factor 2
  Uniprot ID: Q9P2K5
  ENST ID: ENST00000561151
  CDS Start-End: 90-476
gggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaagggttgtggtgtggttgaattcaaagatgaagaatttgtaaagaaagccctagaaactatgaacaaatatgatcttagtggaagaccccttaatattaaagagggaggcctgaggcgacggagagagatggggagcggctggtcggtggagcagtcagaacatttattgattaagttcgctgttttatttgggcacggttgatggtgccccaaaacaattaaaacatcaaagatcactgatcacagatcaccataacagataataatgaagaaggttg

SEQ ID NO: 156329 - DNA, 731 bp, Homo sapiens
  Payload ID: 10665
  Gene Symbol: MYEF2
  Gene Name: myelin expression factor 2
  ENST ID: ENST00000560172
  CDS Start-End: 1-380
tgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggt

SEQ ID NO: 156330 - DNA, 2598 bp, Homo sapiens
  Payload ID: 10665
  Gene Symbol: MYEF2
  Gene Name: myelin expression factor 2
  Uniprot ID: Q9P2K5
  ENST ID: ENST00000561351
  CDS Start-End: 80-466
accgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaagggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtgagtattctaacttcctcttttctttttaaatgatacatatgctagctaataaagcctccattgatgtggtctgtaataatgtttaaaggactctaattaatagttagatatttacggtgtcacttcattctgaaaaaggaatgaaaccttgagcacagctaacatgaaagagataggcagaagtcaggagggtttctttggggccagctatgttgtagctagccttttagcattttggattttgaaatgtcttgaaggcagaaggagaatatatcatctatgaacagtatttatggagtagctgaaatgctaccatatcataggcagctaaaatctgtttatccatttgggaaggtggcttttcaggtagttatttggctgctcacctggaagaactcacagttcatttttagagattggtttttaaactttggtgttaggacccttttatattttaaaatttgttgagaacccgaaaatgctttgtttatgtagttataattaccagtatttactgtattataaatgaaaaattagaaattaaaaaaattacatattaaaaaatgataaactcattacatgttaacatacataaaagttttaagaaaataaactatttttcaatgcaaaaaagaaattggtgaggagagtggcattgttttacctttccacacatctttttaatgtttggcttaatattgctgttatatctgtttctgcactttagttttttgtgatattgtacatcatatagtgtttggaaaattacaccttaaactcaagagaatgagggtaaaacatcaaataatgtcttagtagtatttggtgacttaaatagttttgacctattgaaccctcaagagtccctggaccatactttgtgaattactgttttaattgatggactaataaatgctatcagattcctattttgtcaagatgctgtagtcacactttaaattatgaggctcattatcataatcattctgatccaaacaagttttctcccttacccttagactctcacacctacctaccctctcctaaatacatactatttatattttgaaaatttttactgctcttttaactgcgatgtttagagagtccttacattctggcctgatctctaaatctgctgtaatgctatttctgtgtctatgctggaaaaaaaaaatcattgatagtagtatttctgtgtttattgtggaaaaaaaagtgaatgattacctagttcaagatattctctaactgaatgttgtgggtgttactagtgaattttgctttcttgtctgataaatgttcaaagaaacccttttgaagattcatgattagacagctgctatggcatagcactttaaaccatgcctcctgtaccctaccgcttctctagtgtttcattgtggttataccagtggtatctattttgctataatgcattatatcatcttttagtcataaaaataaaatatacttaaagta

SEQ ID NO: 156331 - DNA, 868 bp, Homo sapiens
  Payload ID: 10665
  Gene Symbol: MYEF2
  Gene Name: myelin expression factor 2
  ENST ID: ENST00000558395
  CDS Start-End: 1-868
tgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatg

SEQ ID NO: 156332 - DNA, 1966 bp, Homo sapiens
  Payload ID: 10665
  Gene Symbol: MYEF2
  Gene Name: myelin expression factor 2
  ENST ID: ENST00000616409
  CDS Start-End: 67-1710
gagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaagggtaagtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggcagtgcaatgattggagggtttgcaggaagaataggatcttctaacatgggtccagtaggatctggaataagtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccatttt

SEQ ID NO: 156333 - DNA, 2591 bp, Homo sapiens
  Payload ID: 10665
  Gene Symbol: MYEF2
  Gene Name: myelin expression factor 2
  ENST ID: ENST00000610570
  CDS Start-End: 80-460
accgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaagggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtgagtattctaacttcctcttttctttttaaatgatacatatgctagctaataaagcctccattgatgtggtctgtaataatgtttaaaggactctaattaatagttagatatttacggtgtcacttcattctgaaaaaggaatgaaaccttgagcacagctaacatgaaagagataggcagaagtcaggagggtttctttggggccagctatgttgtagctagccttttagcattttggattttgaaatgtcttgaaggcagaaggagaatatatcatctatgaacagtatttatggagtagctgaaatgctaccatatcataggcagctaaaatctgtttatccatttgggaaggtggcttttcaggtagttatttggctgctcacctggaagaactcacagttcatttttagagattggtttttaaactttggtgttaggacccttttatattttaaaatttgttgagaacccgaaaatgctttgtttatgtagttataattaccagtatttactgtattataaatgaaaaattagaaattaaaaaaattacatattaaaaaatgataaactcattacatgttaacatacataaaagttttaagaaaataaactatttttcaatgcaaaaaagaaattggtgaggagagtggcattgttttacctttccacacatctttttaatgtttggcttaatattgctgttatatctgtttctgcactttagttttttgtgatattgtacatcatatagtgtttggaaaattacaccttaaactcaagagaatgagggtaaaacatcaaataatgtcttagtagtatttggtgacttaaatagttttgacctattgaaccctcaagagtccctggaccatactttgtgaattactgttttaattgatggactaataaatgctatcagattcctattttgtcaagatgctgtagtcacactttaaattatgaggctcattatcataatcattctgatccaaacaagttttctcccttacccttagactctcacacctacctaccctctcctaaatacatactatttatattttgaaaatttttactgctcttttaactgcgatgtttagagagtccttacattctggcctgatctctaaatctgctgtaatgctatttctgtgtctatgctggaaaaaaaaaatcattgatagtagtatttctgtgtttattgtggaaaaaaaagtgaatgattacctagttcaagatattctctaactgaatgttgtgggtgttactagtgaattttgctttcttgtctgataaatgttcaaagaaacccttttgaagattcatgattagacagctgctatggcatagcactttaaaccatgcctcctgtaccctaccgcttctctagtgtttcattgtggttataccagtggtatctattttgctataatgcattatatcatcttttagtcataaaaataaaatatacttaaagt

SEQ ID NO: 156334 - DNA, 1742 bp, Homo sapiens
  Payload ID: 10665
  Gene Symbol: MYEF2
  Gene Name: myelin expression factor 2
  ENST ID: ENST00000620867
  CDS Start-End: 5-640
gggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttc

SEQ ID NO: 156335 - DNA, 2503 bp, Homo sapiens
  Payload ID: 10666
  Gene Symbol: MOG
  Gene Name: myelin oligodendrocyte glycoprotein
  Uniprot ID: Q16653
  ENST ID: ENST00000259891
  CDS Start-End: 119-1006
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 156336 - DNA, 1568 bp, Homo sapiens
  Payload ID: 10666
  Gene Symbol: MOG
  Gene Name: myelin oligodendrocyte glycoprotein
  Uniprot ID: Q16653
  ENST ID: ENST00000359539
  CDS Start-End: 1-642
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 156337 - DNA, 1529 bp, Homo sapiens
  Payload ID: 10666
  Gene Symbol: MOG
  Gene Name: myelin oligodendrocyte glycoprotein
  Uniprot ID: Q16653
  ENST ID: ENST00000376888
  CDS Start-End: 208-603
cttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaa

SEQ ID NO: 156338 - DNA, 1981 bp, Homo sapiens
  Payload ID: 10666
  Gene Symbol: MOG
  Gene Name: myelin oligodendrocyte glycoprotein
  ENST ID: ENST00000376889
  CDS Start-End: 1-428
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 156339 - DNA, 889 bp, Homo sapiens
  Payload ID: 10666
  Gene Symbol: MOG
  Gene Name: myelin oligodendrocyte glycoprotein
  Uniprot ID: Q16653
  ENST ID: ENST00000376891
  CDS Start-End: 1-621
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 156340 - DNA, 2499 bp, Homo sapiens
  Payload ID: 10666
  Gene Symbol: MOG
  Gene Name: myelin oligodendrocyte glycoprotein
  Uniprot ID: Q16653
  ENST ID: ENST00000376894
  CDS Start-End: 119-1006
agcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 156341 - DNA, 1027 bp, Homo sapiens
  Payload ID: 10666
  Gene Symbol: MOG
  Gene Name: myelin oligodendrocyte glycoprotein
  Uniprot ID: Q16653
  ENST ID: ENST00000376898
  CDS Start-End: 1-759
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 156342 - DNA, 748 bp, Homo sapiens
  Payload ID: 10666
  Gene Symbol: MOG
  Gene Name: myelin oligodendrocyte glycoprotein
  ENST ID: ENST00000376903
  CDS Start-End: 209-346
ccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagact

SEQ ID NO: 156343 - DNA, 2160 bp, Homo sapiens
  Payload ID: 10666
  Gene Symbol: MOG
  Gene Name: myelin oligodendrocyte glycoprotein
  Uniprot ID: Q16653
  ENST ID: ENST00000376917
  CDS Start-End: 230-973
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 156344 - DNA, 1591 bp, Homo sapiens
  Payload ID: 10666
  Gene Symbol: MOG
  Gene Name: myelin oligodendrocyte glycoprotein
  Uniprot ID: Q16653
  ENST ID: ENST00000383521
  CDS Start-End: 1-396
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 156345 - DNA, 2087 bp, Homo sapiens
  Payload ID: 10666
  Gene Symbol: MOG
  Gene Name: myelin oligodendrocyte glycoprotein
  Uniprot ID: Q16653
  ENST ID: ENST00000383525
  CDS Start-End: 149-892
caattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 156346 - DNA, 2146 bp, Homo sapiens
  Payload ID: 10666
  Gene Symbol: MOG
  Gene Name: myelin oligodendrocyte glycoprotein
  Uniprot ID: Q16653
  ENST ID: ENST00000383630
  CDS Start-End: 212-955
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 156347 - DNA, 1616 bp, Homo sapiens
  Payload ID: 10666
  Gene Symbol: MOG
  Gene Name: myelin oligodendrocyte glycoprotein
  Uniprot ID: Q16653
  ENST ID: ENST00000383631
  CDS Start-End: 1-690
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 156348 - DNA, 910 bp, Homo sapiens
  Payload ID: 10666
  Gene Symbol: MOG
  Gene Name: myelin oligodendrocyte glycoprotein
  Uniprot ID: Q16653
  ENST ID: ENST00000396701
  CDS Start-End: 1-642
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 156349 - DNA, 675 bp, Homo sapiens
  Payload ID: 10666
  Gene Symbol: MOG
  Gene Name: myelin oligodendrocyte glycoprotein
  Uniprot ID: Q16653
  ENST ID: ENST00000396704
  CDS Start-End: 1-675
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctga

SEQ ID NO: 156350 - DNA, 1858 bp, Homo sapiens
  Payload ID: 10666
  Gene Symbol: MOG
  Gene Name: myelin oligodendrocyte glycoprotein
  ENST ID: ENST00000400668
  CDS Start-End: 1-675
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 156351 - DNA, 1620 bp, Homo sapiens
  Payload ID: 10666
  Gene Symbol: MOG
  Gene Name: myelin oligodendrocyte glycoprotein
  Uniprot ID: Q16653
  ENST ID: ENST00000400669
  CDS Start-End: 1-690
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 156352 - DNA, 1572 bp, Homo sapiens
  Payload ID: 10666
  Gene Symbol: MOG
  Gene Name: myelin oligodendrocyte glycoprotein
  Uniprot ID: Q16653
  ENST ID: ENST00000400671
  CDS Start-End: 1-642
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 156353 - DNA, 1730 bp, Homo sapiens
  Payload ID: 10666
  Gene Symbol: MOG
  Gene Name: myelin oligodendrocyte glycoprotein
  ENST ID: ENST00000400687
  CDS Start-End: 1-539
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 156354 - DNA, 1587 bp, Homo sapiens
  Payload ID: 10666
  Gene Symbol: MOG
  Gene Name: myelin oligodendrocyte glycoprotein
  Uniprot ID: Q16653
  ENST ID: ENST00000400688
  CDS Start-End: 1-396
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 156355 - DNA, 1541 bp, Homo sapiens
  Payload ID: 10666
  Gene Symbol: MOG
  Gene Name: myelin oligodendrocyte glycoprotein
  Uniprot ID: Q16653
  ENST ID: ENST00000400691
  CDS Start-End: 1-615
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 156356 - DNA, 1579 bp, Homo sapiens
  Payload ID: 10666
  Gene Symbol: MOG
  Gene Name: myelin oligodendrocyte glycoprotein
  ENST ID: ENST00000411455
  CDS Start-End: 1-396
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 156357 - DNA, 2138 bp, Homo sapiens
  Payload ID: 10666
  Gene Symbol: MOG
  Gene Name: myelin oligodendrocyte glycoprotein
  Uniprot ID: Q16653
  ENST ID: ENST00000452744
  CDS Start-End: 212-955
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 156358 - DNA, 2146 bp, Homo sapiens; identical to SEQ ID NO: 156346
  Payload ID: 10666
  Gene Symbol: MOG
  Gene Name: myelin oligodendrocyte glycoprotein
  Uniprot ID: Q16653
  ENST ID: ENST00000432271
  CDS Start-End: 212-955

SEQ ID NO: 156359 - DNA, 1862 bp, Homo sapiens
  Payload ID: 10666
  Gene Symbol: MOG
  Gene Name: myelin oligodendrocyte glycoprotein
  Uniprot ID: Q16653
  ENST ID: ENST00000444674
  CDS Start-End: 1-675
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 156360 - DNA, 2499 bp, Homo sapiens
  Payload ID: 10666
  Gene Symbol: MOG
  Gene Name: myelin oligodendrocyte glycoprotein
  Uniprot ID: Q16653
  ENST ID: ENST00000423895
  CDS Start-End: 119-1006
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 156361 - DNA, 1568 bp, Homo sapiens
  Payload ID: 10666
  Gene Symbol: MOG
  Gene Name: myelin oligodendrocyte glycoprotein
  Uniprot ID: Q16653
  ENST ID: ENST00000420045
  CDS Start-End: 1-642
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 156362 - DNA, 2495 bp, Homo sapiens
  Payload ID: 10666
  Gene Symbol: MOG
  Gene Name: myelin oligodendrocyte glycoprotein
  ENST ID: ENST00000429153
  CDS Start-End: 119-1006
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 156363 - DNA, 1564 bp, Homo sapiens
  Payload ID: 10666
  Gene Symbol: MOG
  Gene Name: myelin oligodendrocyte glycoprotein
  Uniprot ID: Q16653
  ENST ID: ENST00000442244
  CDS Start-End: 1-642
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 156364 - DNA, 2503 bp, Homo sapiens
  Payload ID: 10666
  Gene Symbol: MOG
  Gene Name: myelin oligodendrocyte glycoprotein
  Uniprot ID: Q16653
  ENST ID: ENST00000449096
  CDS Start-End: 119-1006
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 156365 - DNA, 1730 bp, Homo sapiens
  Payload ID: 10666
  Gene Symbol: MOG
  Gene Name: myelin oligodendrocyte glycoprotein
  ENST ID: ENST00000450851
  CDS Start-End: 1-539
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 156366 - DNA, 1685 bp, Homo sapiens
  Payload ID: 10666
  Gene Symbol: MOG
  Gene Name: myelin oligodendrocyte glycoprotein
  ENST ID: ENST00000415631
  CDS Start-End: 1-759
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 156367 - DNA, 1587 bp, Homo sapiens; identical to SEQ ID NO: 156354
  Payload ID: 10666
  Gene Symbol: MOG
  Gene Name: myelin oligodendrocyte glycoprotein
  Uniprot ID: Q16653
  ENST ID: ENST00000452233
  CDS Start-End: 1-396

SEQ ID NO: 156368 - DNA, 2499 bp, Homo sapiens
  Payload ID: 10666
  Gene Symbol: MOG
  Gene Name: myelin oligodendrocyte glycoprotein
  Uniprot ID: Q16653
  ENST ID: ENST00000419309
  CDS Start-End: 119-1006
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 156369 - DNA, 1533 bp, Homo sapiens
  Payload ID: 10666
  Gene Symbol: MOG
  Gene Name: myelin oligodendrocyte glycoprotein
  ENST ID: ENST00000434870
  CDS Start-End: 1-615
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 156370 - DNA, 1685 bp, Homo sapiens; identical to SEQ ID NO: 156366
  Payload ID: 10666
  Gene Symbol: MOG
  Gene Name: myelin oligodendrocyte glycoprotein
  ENST ID: ENST00000427061
  CDS Start-End: 1-759

SEQ ID NO: 156371 - DNA, 1685 bp, Homo sapiens
  Payload ID: 10666
  Gene Symbol: MOG
  Gene Name: myelin oligodendrocyte glycoprotein
  ENST ID: ENST00000418693
  CDS Start-End: 1-759
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 156372 - DNA, 2503 bp, Homo sapiens; identical to SEQ ID NO: 156335
  Payload ID: 10666
  Gene Symbol: MOG
  Gene Name: myelin oligodendrocyte glycoprotein
  Uniprot ID: Q16653
  ENST ID: ENST00000425145
  CDS Start-End: 119-1006

SEQ ID NO: 156373 - DNA, 1541 bp, Homo sapiens
  Payload ID: 10666
  Gene Symbol: MOG
  Gene Name: myelin oligodendrocyte glycoprotein
  Uniprot ID: Q16653
  ENST ID: ENST00000428719
  CDS Start-End: 1-615
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 156374 - DNA, 1545 bp, Homo sapiens
  Payload ID: 10666
  Gene Symbol: MOG
  Gene Name: myelin oligodendrocyte glycoprotein
  Uniprot ID: Q16653
  ENST ID: ENST00000448816
  CDS Start-End: 1-615
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 156375 - DNA, 1568 bp, Homo sapiens; identical to SEQ ID NO: 156336
  Payload ID: 10666
  Gene Symbol: MOG
  Gene Name: myelin oligodendrocyte glycoprotein
  Uniprot ID: Q16653
  ENST ID: ENST00000434177
  CDS Start-End: 1-642

SEQ ID NO: 156376 - DNA, 2507 bp, Homo sapiens
  Payload ID: 10666
  Gene Symbol: MOG
  Gene Name: myelin oligodendrocyte glycoprotein
  Uniprot ID: Q16653
  ENST ID: ENST00000439884
  CDS Start-End: 119-1006
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 156377 - DNA, 1541 bp, Homo sapiens; identical to SEQ ID NO: 156355
  Payload ID: 10666
  Gene Symbol: MOG
  Gene Name: myelin oligodendrocyte glycoprotein
  Uniprot ID: Q16653
  ENST ID: ENST00000442629
  CDS Start-End: 1-615

SEQ ID NO: 156378 - DNA, 1689 bp, Homo sapiens
  Payload ID: 10666
  Gene Symbol: MOG
  Gene Name: myelin oligodendrocyte glycoprotein
  ENST ID: ENST00000444952
  CDS Start-End: 1-759
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 156379 - DNA, 1677 bp, Homo sapiens
  Payload ID: 10666
  Gene Symbol: MOG
  Gene Name: myelin oligodendrocyte glycoprotein
  ENST ID: ENST00000450634
  CDS Start-End: 1-759
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 156380 - DNA, 1730 bp, Homo sapiens; identical to SEQ ID NO: 156353
  Payload ID: 10666
  Gene Symbol: MOG
  Gene Name: myelin oligodendrocyte glycoprotein
  ENST ID: ENST00000417635
  CDS Start-End: 1-539

SEQ ID NO: 156381 - DNA, 2142 bp, Homo sapiens
  Payload ID: 10666
  Gene Symbol: MOG
  Gene Name: myelin oligodendrocyte glycoprotein
  Uniprot ID: Q16653
  ENST ID: ENST00000447285
  CDS Start-End: 212-955
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 156382 - DNA, 1612 bp, Homo sapiens
  Payload ID: 10666
  Gene Symbol: MOG
  Gene Name: myelin oligodendrocyte glycoprotein
  Uniprot ID: Q16653
  ENST ID: ENST00000457626
  CDS Start-End: 1-690
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 156383 - DNA, 1560 bp, Homo sapiens
  Payload ID: 10666
  Gene Symbol: MOG
  Gene Name: myelin oligodendrocyte glycoprotein
  ENST ID: ENST00000453271
  CDS Start-End: 1-642
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 156384 - DNA, 1681 bp, Homo sapiens
  Payload ID: 10666
  Gene Symbol: MOG
  Gene Name: myelin oligodendrocyte glycoprotein
  ENST ID: ENST00000441138
  CDS Start-End: 1-759
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 156385 - DNA, 1616 bp, Homo sapiens; identical to SEQ ID NO: 156347
  Payload ID: 10666
  Gene Symbol: MOG
  Gene Name: myelin oligodendrocyte glycoprotein
  Uniprot ID: Q16653
  ENST ID: ENST00000430264
  CDS Start-End: 1-690

SEQ ID NO: 156386 - DNA, 1734 bp, Homo sapiens
  Payload ID: 10666
  Gene Symbol: MOG
  Gene Name: myelin oligodendrocyte glycoprotein
  ENST ID: ENST00000421858
  CDS Start-End: 1-539
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 156387 - DNA, 1866 bp, Homo sapiens
  Payload ID: 10666
  Gene Symbol: MOG
  Gene Name: myelin oligodendrocyte glycoprotein
  Uniprot ID: Q16653
  ENST ID: ENST00000414889
  CDS Start-End: 1-675
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 156388 - DNA, 1866 bp, Homo sapiens
  Payload ID: 10666
  Gene Symbol: MOG
  Gene Name: myelin oligodendrocyte glycoprotein
  Uniprot ID: Q16653
  ENST ID: ENST00000415546
  CDS Start-End: 1-675
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 156389 - DNA, 1870 bp, Homo sapiens
  Payload ID: 10666
  Gene Symbol: MOG
  Gene Name: myelin oligodendrocyte glycoprotein
  Uniprot ID: Q16653
  ENST ID: ENST00000412760
  CDS Start-End: 1-675
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 156390 - DNA, 1681 bp, Homo sapiens
  Payload ID: 10666
  Gene Symbol: MOG
  Gene Name: myelin oligodendrocyte glycoprotein
  ENST ID: ENST00000421125
  CDS Start-End: 1-759
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 156391 - DNA, 2146 bp, Homo sapiens
  Payload ID: 10666
  Gene Symbol: MOG
  Gene Name: myelin oligodendrocyte glycoprotein
  Uniprot ID: Q16653
  ENST ID: ENST00000417019
  CDS Start-End: 212-955
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 156392 - DNA, 1616 bp, Homo sapiens
  Payload ID: 10666
  Gene Symbol: MOG
  Gene Name: myelin oligodendrocyte glycoprotein
  Uniprot ID: Q16653
  ENST ID: ENST00000439634
  CDS Start-End: 1-690
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 156393 - DNA, 1722 bp, Homo sapiens
  Payload ID: 10666
  Gene Symbol: MOG
  Gene Name: myelin oligodendrocyte glycoprotein
  ENST ID: ENST00000431084
  CDS Start-End: 1-539
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 156394 - DNA, 1726 bp, Homo sapiens
  Payload ID: 10666
  Gene Symbol: MOG
  Gene Name: myelin oligodendrocyte glycoprotein
  ENST ID: ENST00000440073
  CDS Start-End: 1-539
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 156395 - DNA, 1726 bp, Homo sapiens
  Payload ID: 10666
  Gene Symbol: MOG
  Gene Name: myelin oligodendrocyte glycoprotein
  ENST ID: ENST00000417639
  CDS Start-End: 1-539
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 156396 - DNA, 630 bp, Homo sapiens
  Payload ID: 10666
  Gene Symbol: MOG
  Gene Name: myelin oligodendrocyte glycoprotein
  ENST ID: ENST00000416766
  CDS Start-End: 1-630
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctga

SEQ ID NO: 156397 - DNA, 1564 bp, Homo sapiens
  Payload ID: 10666
  Gene Symbol: MOG
  Gene Name: myelin oligodendrocyte glycoprotein
  Uniprot ID: Q16653
  ENST ID: ENST00000440561
  CDS Start-End: 1-642
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 156398 - DNA, 1587 bp, Homo sapiens
  Payload ID: 10666
  Gene Symbol: MOG
  Gene Name: myelin oligodendrocyte glycoprotein
  Uniprot ID: Q16653
  ENST ID: ENST00000430351
  CDS Start-End: 1-396
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 156399 - DNA, 1583 bp, Homo sapiens
  Payload ID: 10666
  Gene Symbol: MOG
  Gene Name: myelin oligodendrocyte glycoprotein
  Uniprot ID: Q16653
  ENST ID: ENST00000426782
  CDS Start-End: 1-396
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 156400 - DNA, 1814 bp, Homo sapiens
  Payload ID: 10666
  Gene Symbol: MOG
  Gene Name: myelin oligodendrocyte glycoprotein
  Uniprot ID: Q16653
  ENST ID: ENST00000431798
  CDS Start-End: 1-627
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 156401 - DNA, 1612 bp, Homo sapiens
  Payload ID: 10666
  Gene Symbol: MOG
  Gene Name: myelin oligodendrocyte glycoprotein
  Uniprot ID: Q16653
  ENST ID: ENST00000419274
  CDS Start-End: 1-690
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 156402 - DNA, 1583 bp, Homo sapiens
  Payload ID: 10666
  Gene Symbol: MOG
  Gene Name: myelin oligodendrocyte glycoprotein
  Uniprot ID: Q16653
  ENST ID: ENST00000433500
  CDS Start-End: 1-396
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 156403 - DNA, 1537 bp, Homo sapiens
  Payload ID: 10666
  Gene Symbol: MOG
  Gene Name: myelin oligodendrocyte glycoprotein
  Uniprot ID: Q16653
  ENST ID: ENST00000458179
  CDS Start-End: 1-615
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 156404 - DNA, 1866 bp, Homo sapiens; identical to SEQ ID NO: 156387
  Payload ID: 10666
  Gene Symbol: MOG
  Gene Name: myelin oligodendrocyte glycoprotein
  Uniprot ID: Q16653
  ENST ID: ENST00000442444
  CDS Start-End: 1-675

SEQ ID NO: 156405 - DNA, 2142 bp, Homo sapiens
  Payload ID: 10666
  Gene Symbol: MOG
  Gene Name: myelin oligodendrocyte glycoprotein
  Uniprot ID: Q16653
  ENST ID: ENST00000427289
  CDS Start-End: 212-955
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 156406 - DNA, 1862 bp, Homo sapiens
  Payload ID: 10666
  Gene Symbol: MOG
  Gene Name: myelin oligodendrocyte glycoprotein
  Uniprot ID: Q16653
  ENST ID: ENST00000438803
  CDS Start-End: 1-675
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 156407 - DNA, 1537 bp, Homo sapiens
  Payload ID: 10666
  Gene Symbol: MOG
  Gene Name: myelin oligodendrocyte glycoprotein
  Uniprot ID: Q16653
  ENST ID: ENST00000457090
  CDS Start-End: 1-615
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 156408 - DNA, 958 bp, Homo sapiens
  Payload ID: 10666
  Gene Symbol: MOG
  Gene Name: myelin oligodendrocyte glycoprotein
  Uniprot ID: Q16653
  ENST ID: ENST00000494692
  CDS Start-End: 1-690
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 156409 - DNA, 279 bp, Homo sapiens
  Payload ID: 10666
  Gene Symbol: MOG
  Gene Name: myelin oligodendrocyte glycoprotein
  ENST ID: ENST00000483013
  CDS Start-End: 1-279
atggcaagcttatcaagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgggcaattccttgaagagctacgaaatcccttctga

SEQ ID NO: 156410 - DNA, 1077 bp, Homo sapiens
  Payload ID: 10666
  Gene Symbol: MOG
  Gene Name: myelin oligodendrocyte glycoprotein
  ENST ID: ENST00000485211
  CDS Start-End: 1-428
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 156411 - DNA, 1608 bp, Homo sapiens
  Payload ID: 10666
  Gene Symbol: MOG
  Gene Name: myelin oligodendrocyte glycoprotein
  ENST ID: ENST00000459677
  CDS Start-End: 1-690
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 156412 - DNA, 327 bp, Homo sapiens
  Payload ID: 10666
  Gene Symbol: MOG
  Gene Name: myelin oligodendrocyte glycoprotein
  Uniprot ID: Q16653
  ENST ID: ENST00000490427
  CDS Start-End: 1-327
atggcaagcttatcaagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctga

SEQ ID NO: 156413 - DNA, 2041 bp, Homo sapiens
  Payload ID: 10666
  Gene Symbol: MOG
  Gene Name: myelin oligodendrocyte glycoprotein
  Uniprot ID: Q16653
  ENST ID: ENST00000551993
  CDS Start-End: 230-856
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttct

SEQ ID NO: 156414 - DNA, 2041 bp, Homo sapiens
  Payload ID: 10666
  Gene Symbol: MOG
  Gene Name: myelin oligodendrocyte glycoprotein
  Uniprot ID: Q16653
  ENST ID: ENST00000553111
  CDS Start-End: 230-856
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttct

SEQ ID NO: 156415 - DNA, 2045 bp, Homo sapiens
  Payload ID: 10666
  Gene Symbol: MOG
  Gene Name: myelin oligodendrocyte glycoprotein
  Uniprot ID: Q16653
  ENST ID: ENST00000548017
  CDS Start-End: 230-856
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttct

SEQ ID NO: 156416 - DNA, 2045 bp, Homo sapiens
  Payload ID: 10666
  Gene Symbol: MOG
  Gene Name: myelin oligodendrocyte glycoprotein
  Uniprot ID: Q16653
  ENST ID: ENST00000551175
  CDS Start-End: 230-856
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttct

SEQ ID NO: 156417 - DNA, 2045 bp, Homo sapiens; identical to SEQ ID NO: 156416
  Payload ID: 10666
  Gene Symbol: MOG
  Gene Name: myelin oligodendrocyte glycoprotein
  Uniprot ID: Q16653
  ENST ID: ENST00000547083
  CDS Start-End: 230-856

SEQ ID NO: 156418 - DNA, 2049 bp, Homo sapiens
  Payload ID: 10666
  Gene Symbol: MOG
  Gene Name: myelin oligodendrocyte glycoprotein
  Uniprot ID: Q16653
  ENST ID: ENST00000550849
  CDS Start-End: 230-856
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttct

SEQ ID NO: 156419 - DNA, 1824 bp, Homo sapiens
  Payload ID: 10667
  Gene Symbol: MPZ
  Gene Name: myelin protein zero
  ENST ID: ENST00000491222
  CDS Start-End: 569-727
cttactgggcccataggtgcatctgattccccactttgtgcttgcagtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacc

SEQ ID NO: 156420 - DNA, 1693 bp, Homo sapiens
  Payload ID: 10667
  Gene Symbol: MPZ
  Gene Name: myelin protein zero
  Uniprot ID: P25189
  ENST ID: ENST00000463290
  CDS Start-End: 50-796
cactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 156421 - DNA, 1955 bp, Homo sapiens
  Payload ID: 10667
  Gene Symbol: MPZ
  Gene Name: myelin protein zero
  Uniprot ID: P25189
  ENST ID: ENST00000533357
  CDS Start-End: 68-814
gttcagttcctggtcccccactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 156422 - DNA, 957 bp, Homo sapiens
  Payload ID: 10667
  Gene Symbol: MPZ
  Gene Name: myelin protein zero
  ENST ID: ENST00000526189
  CDS Start-End: 1-410
aaccctacattgacgaggtggggaccttcaaagagcgcatccagtgggtaggggaccctcgctggaaggatggctccattgtcatacacaacctagactacagtgacaatgtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgttt

SEQ ID NO: 156423 - DNA, 5010 bp, Homo sapiens
  Payload ID: 10668
  Gene Symbol: MPZL1
  Gene Name: myelin protein zero-like 1
  Uniprot ID: O95297
  ENST ID: ENST00000359523
  CDS Start-End: 203-1012
agcgagggccggagtggggctgaggcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacatctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacattgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaattgtgttgtgtgctcattttgaccagaatagaaaaagagatatgcctttcactcatatcattccagctacacctgccttcttttcttcaaaaatgccgtccgtgtgcctgcttctgggcctttgcacatgctgttccctgggcctgaagcatgccttctgccaatattcctgtggtttgctctctgacttcctttaagcctctgctcaaatgttacctcctcagggagaccttctgtgatatataaaagagcaagccccccaccccaccgcctcagccttcctggccccctcagttctgctctagttactctatttctctccctctttcccagtacacacttgtctgttctcccgcattagaacatagttaacaagagaccagaaccttgctgttttgttcactgctccgtctgcagtaaagggaacagcacctggcacttagctgctcaatacatgttacgtggatggatgagtaggtggaagcattcatccattcagcaacctacactgagaacaatcctgtgccaagcactgtgctaagcataaggaaacaaaacaagacaaagctcctcaaggagcttgccacagggtggaggtgacaggtgacatgaatggaagtaactagtagttaccaaatacttggtgtgagccaggcactttgcatttctttctctattatttctgtgagttaacagtaattgtactaatcttaatcccattgtttgaaagattatatggcttacccagggccacttagctaataaaggaacagagaagaggggctgggcctggggccgctgtttgatccacagccttgttcctaaccactatgccctgtggcctctcacaccaaaaggaagtaccaaactgcttccttactcaaataaatgtgctgaaatgcagttgcagttttctcccagtcccttaggagctggttagagagtcccttaggaacttgagagggtagtgtagtctaggtggtaggcacagatgtctgagagctttaacctcagtctggaagacaatgtggtgacttaatttgttgagaactatgttacaaataatgtgttactaataaaacattgaggcttcgca

SEQ ID NO: 156424 - DNA, 881 bp, Homo sapiens
  Payload ID: 10668
  Gene Symbol: MPZL1
  Gene Name: myelin protein zero-like 1
  ENST ID: ENST00000367853
  CDS Start-End: 1-552
cctttctcttcagtgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtt

SEQ ID NO: 156425 - DNA, 3421 bp, Homo sapiens
  Payload ID: 10668
  Gene Symbol: MPZL1
  Gene Name: myelin protein zero-like 1
  Uniprot ID: O95297
  ENST ID: ENST00000392121
  CDS Start-End: 164-523
tggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacatctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacattgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttc

SEQ ID NO: 156426 - DNA, 1596 bp, Homo sapiens
  Payload ID: 10668
  Gene Symbol: MPZL1
  Gene Name: myelin protein zero-like 1
  ENST ID: ENST00000448405
  CDS Start-End: 169-456
agagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttga

SEQ ID NO: 156427 - DNA, 630 bp, Homo sapiens
  Payload ID: 10668
  Gene Symbol: MPZL1
  Gene Name: myelin protein zero-like 1
  Uniprot ID: O95297
  ENST ID: ENST00000474859
  CDS Start-End: 1-630
atggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggggcccagtcatatatgcacagttag

SEQ ID NO: 156428 - DNA, 2620 bp, Homo sapiens
  Payload ID: 10669
  Gene Symbol: MPZL2
  Gene Name: myelin protein zero-like 2
  Uniprot ID: O60487
  ENST ID: ENST00000278937
  CDS Start-End: 130-777
gaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaagggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaaaattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttatataatttgtgtatatac

SEQ ID NO: 156429 - DNA, 1370 bp, Homo sapiens
  Payload ID: 10669
  Gene Symbol: MPZL2
  Gene Name: myelin protein zero-like 2
  Uniprot ID: O60487
  ENST ID: ENST00000438295
  CDS Start-End: 384-1031
aacagtctgggacatttcagactggcaccacctcctctggctgtttccgaggccatctagaggccagagcccagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttattactactactactaataaatattcaacaagtaaataaatcttttttaaatcaaaa

SEQ ID NO: 156430 - DNA, 3968 bp, Homo sapiens
  Payload ID: 10670
  Gene Symbol: MPZL3
  Gene Name: myelin protein zero-like 3
  Uniprot ID: Q6UWV2
  ENST ID: ENST00000278949
  CDS Start-End: 57-764
tgtgtcgttaccgggagctgtaaacaaggtgtgcaagcatctgaagagctgccgggatgcagcagagaggagcagctggaagccgtggctgcgctctcttccctctgctgggcgtcctgttcttccagggtgtttatatcgtcttttccttggagattcgtgcagatgcccatgtccgaggttatgttggagaaaagatcaagttgaaatgcactttcaagtcaacttcagatgtcactgacaaacttactatagactggacatatcgccctcccagcagcagccacacagtatcaatatttcattatcagtctttccagtacccaaccacagcaggcacatttcgggatcggatttcctgggttggaaatgtatacaaaggggatgcatctataagtataagcaaccctaccataaaggacaatgggacattcagctgtgctgtgaagaatcccccagatgtgcatcataatattcccatgacagagctaacagtcacagaaaggggttttggcaccatgctttcctctgtggcccttctttccatccttgtctttgtgccctcagccgtggtggttgctctgctgctggtgagaatggggaggaaggctgctgggctgaagaagaggagcaggtctggctataagaagtcatctattgaggtttccgatgacactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaactctcataagagactcatgacttcccctttcaatgaattatgctgtaattgaatgaagaaattcttttcctgagcaaaaagatactttttgattcatctttgctctggaatgtattacatgttttcttccaactgtttgaaggagaattttgaatgtttgccacaccgctgatacccaaataattttttaaatgaagtggagcttgtggcttcctgatgtgtcaccagacaaaatattcgcttgggatatgtattctttgttttttgctccatgtacactttcagctgtgagttagtatagggcgtatacttaccggtttaatgacctcaacctcagttgtgtttggataacttagggtgtatacccttagtttccttagagttggtaggatcaagtcattggtttgctttgactgggtttttaaagtattaagtacagtgtcatcaatttacagttaaggaaaggaatcgtgaagtagaaaaattattttctttagtcttgctggtacaatttgggctaaggagtctttgttattttctgtcttgcttttttttttttttttttttttttgaggcagagtctcactctgtcgccaggctggagtgcagtggtgtgatcttggctcactgcaacctctgcctcctgggttcaagcgattcttgtgcctcagcctctcgagtagctgggattacaggcatgcgccaccacacccagctaatttttgtgtttttagtagagacggggtttcaccattttggccaggatggtctcaatcccctgacctcgtgatccacctgcctcggcctcccaaagtgttgggattacaggcatgagccactgtgcttggcctgttattttattttcttataactacaacttttcttcttgaattttcaggtcagaggcaagaaaaactctttacaggtttttagtggggggcttatggagtatttcaggagttctttgcaaattaaatcatcttttcacttgtattgtttttcaaaactttgttgatttctaaaatgtgccaactgtgagtaaactatggtatttgcaagtggtttttacataatatttgagatgaggaagtgagattgtgcatgacatacttctcctttgtattctctcagtgccttacagcaggttactccattctgctatgacaacttgtttcaaatgttaatttacataggattttttataagccattaaggcatatgtatagtatatcagtaaagatggatggtgcatatataaatagtcttctgtaatagtgattggatttacttctcaattatgagagacaaaaattatcccctcacctgtctctattctttcaacaggttgatcccttttcatgatttttcattaggtggttcaggaagtttccatattacagcgcttcagactgtatatgttagtttaaaaatcacttttctctctctcaacttctttcttttttttttgaagacttaatttaaaaaatttgggttgttagatccgtatcatagatttggcctagcctcttctgttaacctagtccacagatgagcgaatctggttagttgaaggacattgtgatttgactctggtcacgcgaggaagtagaagggcaaagacaggaccggcagtttacatttccagtggttaaacctcacggtactttgggactgcttgttaacttttgtggttgtctgaggccaatctaacgtgaccatttctgacacctcaacagagagaggaaagcaacttgagcaatgagagtaaataacttgggctctcagagatttgaagatagagatctcattgtgagggggactattttgcaggtcctcatttctccaagaaagagatggtgttacaggaacccactgaaagccatatcccattaaatgaggaactaattttggctgggccttcttgtaatgtcctcgcaggtgtgttgtgaagattaatgcagggtagtatgtttgtagattgacacctagtctaaacttgaggtaattggtgctctgtgaatactcagtcgtgttcttttatagccttaatcatgatttgaactagtcccttgctttttaaatgactgaatgaagtccttcgtggtaagggagtacgttgataacttagtttactatatgggtttgtggtcgcatcccagtcatcagctgctatcattttccttcttcatcccttatactgagatttgggttacagctttttattcttcgaaggatcacaaagcagtgtacagacacctgccttctttaaggatgaaaggaagataaagtggtctttttttgtttacttatttgtttcacctcttgtttgagtaacttctaaggtgctattctctctctctttttgctacctcatgagctcttgtcacagccatggaaaccagcctcgtttagaaagggaacttagttcagaaggggttaaaagccttccagaatttttctttagctgctgaagtttttacatgtggttacatgactttaagttttatgcattacgctcttaattctattacaaaatgtggactcaccaattgctttgtgttttccatgtgacctgttacttcaggctacttggggaacatcttagtcctctgtagctcctgaacccagcactggtgcttcaagagagaaggtagcacgtctttgttcaaaacaaaacaaaacgacacttctggaggccacatcctgaatatgaatgttctactaagtcactcagttatggttctaaagggaaactgtaagaagacccacaaggagtggaccaagactattatttaattgcacaacttgaaactttgctgccagaagaggcagctccattcctttgactccagtgttgggctgttaactgctgcacctcattgcctttttttgtttttgtttttgttttgtaggagggtaggcactgttgggccatatgcacaaatattgtaactcttggtatctttactgcatcatagtcaataaacttctttgtaccctttggcta

SEQ ID NO: 156431 - DNA, 963 bp, Homo sapiens
  Payload ID: 10670
  Gene Symbol: MPZL3
  Gene Name: myelin protein zero-like 3
  Uniprot ID: Q6UWV2
  ENST ID: ENST00000446386
  CDS Start-End: 27-353
gtgcaagcatctgaagagctgccgggatgcagcagagaggagcagctggaagccgtggctgcgctctcttccctctgctgggcgtcctgttcttccagggtgtttatatcgtcttttccttggagattcgtgcagatgcccatgtccgaggttatgttggagaaaagatcaagttgaaatgcactttcaagtcaacttcagatgtcactgacaaacttactatagactggacatatcgccctcccagcagcagccacacagtatcagttttggcaccatgctttcctctgtggcccttctttccatccttgtctttgtgccctcagccgtggtggttgctctgctgctggtgagaatggggaggaaggctgctgggctgaagaagaggagcaggtctggctataagaagtcatctattgaggtttccgatgacactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaactctcataagagactcatgacttcccctttcaatgaattatgctgtaattgaatgaagaaattcttttcctgagcaaaaagatactttttgattcatctttgctctggaatgtattacatgttttcttccaactgtttgaaggagaattttgaatgtttgccacaccgctgatacccaaataattttttaaatgaagtggagcttgtggcttcctgatgtgtcaccagacaaaatattcgctt

SEQ ID NO: 156432 - DNA, 1381 bp, Homo sapiens
  Payload ID: 10670
  Gene Symbol: MPZL3
  Gene Name: myelin protein zero-like 3
  Uniprot ID: Q6UWV2
  ENST ID: ENST00000527472
  CDS Start-End: 54-725
gtcgttaccgggagctgtaaacaaggtgtgcaagcatctgaagagctgccgggatgcagcagagaggagcagctggaagccgtggctgcgctctcttccctctgctgggcgtcctgttcttccaggatgcccatgtccgaggttatgttggagaaaagatcaagttgaaatgcactttcaagtcaacttcagatgtcactgacaaacttactatagactggacatatcgccctcccagcagcagccacacagtatcaatatttcattatcagtctttccagtacccaaccacagcaggcacatttcgggatcggatttcctgggttggaaatgtatacaaaggggatgcatctataagtataagcaaccctaccataaaggacaatgggacattcagctgtgctgtgaagaatcccccagatgtgcatcataatattcccatgacagagctaacagtcacagaaaggggttttggcaccatgctttcctctgtggcccttctttccatccttgtctttgtgccctcagccgtggtggttgctctgctgctggtgagaatggggaggaaggctgctgggctgaagaagaggagcaggtctggctataagaagtcatctattgaggtttccgatgacactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaactctcataagagactcatgacttcccctttcaatgaattatgctgtaattgaatgaagaaattcttttcctgagcaaaaagatactttttgattcatctttgctctggaatgtattacatgttttcttccaactgtttgaaggagaattttgaatgtttgccacaccgctgatacccaaataattttttaaatgaagtggagcttgtggcttcctgatgtgtcaccagacaaaatattcgcttgggatatgtattctttgttttttgctccatgtacactttcagctgtgagttagtatagggcgtatacttaccggtttaatgacctcaacctcagttgtgtttggataacttagggtgtatacccttagtttccttagagttggtaggatcaagtcattggtttgctttgactgggtttttaaagtattaagtacagtgtcatcaatttacagttaa

SEQ ID NO: 156433 - DNA, 973 bp, Homo sapiens
  Payload ID: 10670
  Gene Symbol: MPZL3
  Gene Name: myelin protein zero-like 3
  ENST ID: ENST00000525386
  CDS Start-End: 54-251
gtcgttaccgggagctgtaaacaaggtgtgcaagcatctgaagagctgccgggatgcagcagagaggagcagctggaagccgtggctgcgctctcttccctctgctgggcgtcctgttcttccaggcactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaactctcataagagactcatgacttcccctttcaatgaattatgctgtaattgaatgaagaaattcttttcctgagcaaaaagatactttttgattcatctttgctctggaatgtattacatgttttcttccaactgtttgaaggagaattttgaatgtttgccacaccgctgatacccaaataattttttaaatgaagtggagcttgtggcttcctgatgtgtcaccagacaaaatattcgcttgggatatgtattctttgttttttgctccatgtacactttcagctgtgagttagtatagggcgtatacttaccggtttaatgacctcaacctcagttgtgtttggataacttagggtgtatacccttagtttccttagagttggtaggatcaagtcattggtttgctttgactgggtttttaaagtattaagtacagtgtcatcaatttacagttaaggaaaggaatcgtgaagtagaaaaattattttctttagtcttgctggtacaatttgggctaaggagtctttgttattttctgtcttgctttttttttttt

SEQ ID NO: 156434 - DNA, 5745 bp, Homo sapiens
  Payload ID: 10671
  Gene Symbol: MYRF
  Gene Name: myelin regulatory factor
  Uniprot ID: Q9Y2G1
  ENST ID: ENST00000265460
  CDS Start-End: 36-3371
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctg

SEQ ID NO: 156435 - DNA, 5927 bp, Homo sapiens
  Payload ID: 10671
  Gene Symbol: MYRF
  Gene Name: myelin regulatory factor
  Uniprot ID: Q9Y2G1
  ENST ID: ENST00000278836
  CDS Start-End: 97-3552
agccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagcctctctccttgcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 156436 - DNA, 2052 bp, Homo sapiens
  Payload ID: 10671
  Gene Symbol: MYRF
  Gene Name: myelin regulatory factor
  ENST ID: ENST00000389602
  CDS Start-End: 165-1778
atctaaccactccagtggtggggtctcctctccacactgcagcctccaggctgccgccctcctgggctccggggcctgctccgggacggccgcaggaggggttcattcccgggcctggctccccgcaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctcttt

SEQ ID NO: 156437 - DNA, 820 bp, Homo sapiens
  Payload ID: 10672
  Gene Symbol: MYRFL
  Gene Name: myelin regulatory factor-like
  ENST ID: ENST00000299350
  CDS Start-End: 1-753
atggtgtttcttgctttgacgatagttgccctctatatacttagcttaaaagatcaagaccgacgtgtcccaaatctccctccaagcaatatcacaagctcacaggagccagctctgctgcccacagcctcctcctcagcacctaatacatccctggtaaccacaccggcctccttacaagtacctgaaattactttctgtgaaatcctgccgtgtcaggagacttattgctgccccatccggggaatgaaagaagtctcttcaagtcctgtgcaaagacaatctgaggagaaggaattccatcagaggcgatggtcagaagacaaaagcaaatcagttttggcaagaaatgcactcagcggccctgactgggagagtgactggattgatacaaccatcagttctattcagattatggaaatccagcaaataatagatcatcagtattgcattcaaagcctccagtgcggcacaacagagccattgatagtcttccagtgcaaattcacccttggaaatatatgtttccatagtaaaaggggaaccaaagggctggaaagccacagagaaatctcccaggagatgacacagggatatcagcacatttggagcctccctgtagccccattttctgacagcatgttccatttccgtgtagctgcaccggatttagctgactgttcaactgatccttattttgctgggatattcttcaccgattacttcttttacttctatcgacgctgtgcctaatttgttcaagtttggggactttaccaaagaaaaatactcaggaatacatttaacagaaacgaacatc

SEQ ID NO: 156438 - DNA, 881 bp, Homo sapiens
  Payload ID: 10672
  Gene Symbol: MYRFL
  Gene Name: myelin regulatory factor-like
  ENST ID: ENST00000535034
  CDS Start-End: 53-805
ggcgtgtcctaattgggttttccagaccttggttataactctgattgctgtgatggcattttgtgctttgacgatagttgccctctatatacttagcttaaaagatcaagaccgacgtgtcccaaatctccctccaagcaatatcacaagctcacaggagccagctctgctgcccacagcctcctcctcagcacctaatacatccctggtaaccacaccggcctccttacaagtacctgaaattactttctgtgaaatcctgccgtgtcaggagacttattgctgccccatccggggaatgaaagaagtctcttcaagtcctgtgcaaagacaatctgaggagaaggaattccatcagaggcgatggtcagaagacaaaagcaaatcagttttggcaagaaatgcactcagcggccctgactgggagagtgactggattgatacaaccatcagttctattcagattatggaaatccagcaaataatagatcatcagtattgcattcaaagcctccagtgcggcacaacagagccattgatagtcttccagtgcaaattcacccttggaaatatatgtttccatagtaaaaggggaaccaaagggctggaaagccacagagaaatctcccaggagatgacacagggatatcagcacatttggagcctccctgtagccccattttctgacagcatgttccatttccgtgtagctgcaccggatttagctgactgttcaactgatccttattttgctgggatattcttcaccgattacttcttttacttctatcgacgctgtgcctaatttgttcaagtttggggactttaccaaagaaaaatactcaggaatacatttaacagaaacgaacatcctcttgcaa

SEQ ID NO: 156439 - DNA, 1319 bp, Homo sapiens
  Payload ID: 10672
  Gene Symbol: MYRFL
  Gene Name: myelin regulatory factor-like
  ENST ID: ENST00000548892
  CDS Start-End: 1-1127
agatctttatggaaaatgtaggtgcagtgaagcaactgtgcaaactaactaacaaccttgaggaaagaatagaagagttagaaatatggaacagaaagctggcccggctaaagcggctcagtagttggaagtcatcagccagtgaagcaagcacaatcagcaaatctagcagagccgttagtgcatcttctccaagaagggccgttcataaaaaaaacaacaaggtttatttttcaggaaaaagacaggcgtgtcctaattgggttttccagaccttggttataactctgattgctgtgatggcattttgtgctttgacgatagttgccctctatatacttagcttaaaagatcaagaccgacgtgtcccaaatctccctccaagcaatatcacaagctcacaggagccagctctgctgcccacagcctcctcctcagcacctaatacatccctggtaaccacaccggcctccttacaagtacctgaaattactttctgtgaaatcctgccgtgtcaggagacttattgctgccccatccggggaatgaaagaagtctcttcaagtcctgtgcaaagacaatctgaggagaaggaattccatcagaggcgatggtcagaagacaaaagcaaatcagttttggcaagaaatgcactcagcggccctgactgggagagtgactggattgatacaaccatcagttctattcagattatggaaatccagcaaataatagatcatcagtattgcattcaaagcctccagtgcggatctggaaattataattacaatattcctgttaataaacacacacccaccaatgtcaagttctctctggaaataaacacaacagagccattgatagtcttccagtgcaaattcacccttggaaatatatgtttccatagtaaaaggggaaccaaagggctggaaagccacagagaaatctcccaggagatgacacagggatatcagcacatttggagcctccctgtagccccattttctgacagcatgttccatttccgtgtagctgcaccggatttagctgactgttcaactgatccttattttgctgggatattcttcaccgattacttcttttacttctatcgacgctgtgcctaatttgttcaagtttggggactttaccaaagaaaaatactcaggaatacatttaacagaaacgaacatcctcttgcaacttcttttttcttctttgtaaaacatttacgtttattgctgaaggactttttcaggctttagcttccaacagttttgagacattaatgaggagaataaaatgtttgctgaaacttg

SEQ ID NO: 156440 - DNA, 3139 bp, Homo sapiens
  Payload ID: 10672
  Gene Symbol: MYRFL
  Gene Name: myelin regulatory factor-like
  Uniprot ID: Q96LU7
  ENST ID: ENST00000552032
  CDS Start-End: 215-2947
tggttgtatatccttccagttttataatcacatttgaaaactcaaccatctttctgggcacaatttgatggctgaagatatgcttcactccaataaaaagaaaatgaagatttttcaagagcattcgtaggcttcgaatcaaaaggacagtacttatttcctgaggtctgataaccgttgttttatgaggaaatagtactaggatcacagtaccatggatgtggtaggcgaaaatgaggccctgcagcagttctttgaagctcagggagccaatggtactctggagaacccagccctggacacaagtctgttggaggaatttctgggcaatgactttgatttgggggccttgcaacgccagctcccagacaccccgccctattctgcatccgactcatgctctcctccgcaggtcaaaggtgcatgctacccaaccctgaggcccacagctgggaggactccagctccttttctccaccccacagctgctcctgcgatgccgcccatgcacccgctgcagagcacctctggaatgggcgactcctgccaaatccacggaggctttcacagctgccactcaaacgccagtcatcttgccacccccctggaccaatccgtgtcctcccatctggggataggttgttcttaccctcagcagcctctgtgtcacagccctggagcctcattgcctccaaccaagaagagaaagtgcacgcaggcactggaggactccggggaatgccgagtgtgggcctgccactgcagaccgatgacaagtaggagtcgcagcagtgaagtccaggaccctgacagtgagggacagaacagaatgcctacagaccagtgctctcctgctctgaagtggcaaccatgccatagtgttccttggcacagcttattaaacagtcattatgaaaaactacctgatgtgggctatcgagttgtaacagacaaaggatttaatttttcaccagcagatgaagcttttgtttgccaaaagaagaatcatttccagataaccattcacatccaagtttggggaagtccaaaatttgttgaaaccgagatgggcctaaagccaatagaaatgttttacttgaaagtttttggcactaaggtggaagctaccaatcaaataattgctattgaacagtcccaagcagataggagcaaaaagattttcaatcctgttaaaattgacctactggctgaccaggtcaccaaagtaacactgggacgattacacttcagcgaaaccacagcaaataatatgagaaaaaagggaaaaccaaatccagaccagagatacttcatgttggtggttggactgtatgctgctaaccaagaccagttctatctgttgtctgcccacatctctgaaaggatcattgtaagggcctctaaccctgggcagtttgaaaatgacagtgatgcattgtggcagcgaggacaagttccagaatctattgtctgtcacggtcgagtaggaatcaacacagatgcgccggacgaagccctggttgtctgtggcaacatgaaagtgatggggaccatcatgcatccctctgacagccgggcaaagcagaatatccaggaggttgacacgaatgaacagctgaaaagaatagcccaaatgagaattgttgaatatgactacaaacctgaatttgcatctgcaatgggaataaacactgcccatcaaacaggaatgattgcccaggaggtgcaagaaatcctgcccagagcagtaagagaggttggtgatgtcacctgcggaaacggagagaccttggagaacttcctcatggtggataaggaccagatctttatggaaaatgtaggtgcagtgaagcaactgtgcaaactaactaacaaccttgaggaaagaatagaagagttagaaatatggaacagaaagctggcccggctaaagcggctcagtagttggaagtcatcagccagtgaagcaagcacaatcagcaaatctagcagagccgttagtgcatcttctccaagaagggccgttcataaaaaaaacaacaaggtttatttttcaggaaaaagacaggcgtgtcctaattgggttttccagaccttggttataactctgattgctgtgatggcattttgtgctttgacgatagttgccctctatatacttagcttaaaagatcaagaccgacgtgtcccaaatctccctccaagcaatatcacaagctcacaggagccagctctgctgcccacagcctcctcctcagcacctaatacatccctggtaaccacaccggcctccttacaagtacctgaaattactttctgtgaaatcctgccgtgtcaggagacttattgctgccccatccggggaatgaaagaagtctcttcaagtcctgtgcaaagacaatctgaggagaaggaattccatcagaggcgatggtcagaagacaaaagcaaatcagttttggcaagaaatgcactcagcggccctgactgggagagtgactggattgatacaaccatcagttctattcagattatggaaatccagcaaataatagatcatcagtattgcattcaaagcctccagtgcggatctggaaattataattacaatattcctgttaataaacacacacccaccaatgtcaagttctctctggaaataaacacaacagagccattgatagtcttccagtgcaaattcacccttggaaatatatgtttccatagtaaaaggggaaccaaagggctggaaagccacagagaaatctcccaggagatgacacagggatatcagcacatttggagcctccctgtagccccattttctgacagcatgttccatttccgtgtagctgcaccggatttagctgactgttcaactgatccttattttgctgggatattcttcaccgattacttcttttacttctatcgacgctgtgcctaatttgttcaagtttggggactttaccaaagaaaaatactcaggaatacatttaacagaaacgaacatcctcttgcaacttcttttttcttctttgtaaaacatttacgtttattgctgaaggactttttcaggctttagcttccaacagttttgagacattaatgaggagaataaaatgtttgctgaaacttg

SEQ ID NO: 156441 - DNA, 3465 bp, Homo sapiens
  Payload ID: 10672
  Gene Symbol: MYRFL
  Gene Name: myelin regulatory factor-like
  ENST ID: ENST00000547771
  CDS Start-End: 203-2899
cttccagttttataatcacatttgaaaactcaaccatctttctgggcacaatttgatggctgaagatatgcttcactccaataaaaagaaaatgaagatttttcaagagcattcgtaggcttcgaatcaaaaggacagtacttatttcctgaggtctgataaccgttgttttatgaggaaatagtactaggatcacagtaccatggatgtggtaggcgaaaatgaggccctgcagcagttctttgaagctcagggagccaatggtactctggagaacccagccctggacacaagtctgttggaggaatttctgggcaatgactttgatttgggggccttgcaacgccagctcccagacaccccgccctattctgcatccgactcatgctctcctccgcaggtcaaaggtgcatgctacccaaccctgaggcccacagctgggaggactccagctccttttctccaccccacagctgctcctgcgatgccgcccatgcacccgctgcagagcacctctggaatgggcgactcctgccaaatccacggaggctttcacagctgccactcaaacgccagtcatcttgccacccccctggaccaatccgtgtcctcccatctggggataggttgttcttaccctcagcagcctctgtgtcacagccctggagcctcattgcctccaaccaagaagagaaagtgcacgcaggcactggaggactccggggaatgccgagtgtgggcctgccactgcagaccgatgacaagtaggagtcgcagcagtgaagtccaggaccctgacagtgagggacagaacagaatgcctacagaccagtgctctcctgctctgaagtggcaaccatgccatagtgttccttggcacagcttattaaacagtcattatgaaaaactacctgatgtgggctatcgagttgtaacagacaaaggatttaatttttcaccagcagatgaagcttttgtttgccaaaagaagaatcatttccagataaccattcacatccaagtttggggaagtccaaaatttgttgaaaccgagatgggcctaaagccaatagaaatgttttacttgaaagtttttggcactaaggtggaagctaccaatcaaataattgctattgaacagtcccaagcagataggagcaaaaagattttcaatcctgttaaaattgacctactggctgaccaggtcaccaaagtaacactgggacgattacacttcagcgaaaccacagcaaataatatgagaaaaaagggaaaaccaaatccagaccagagatacttcatgttggtggttggactgtatgctgctaaccaagaccagttctatctgttgtctgcccacatctctgaaaggatcattgtaagggcctctaaccctgggcagtttgaaaatgacagtgatgcattgtggcagcgaggacaagttccagaatctattgtctgtcacggtcgagtaggaatcaacacagatgcgccggacgaagccctggttgtctgtggcaacatgaaagtgatggggaccatcatgcatccctctgacagccgggcaaagcagaatatccaggaggttgacacgaatgaacagctgaaaagaatagcccaaatgagaattgttgaatatgactacaaacctgaatttgcatctgcaatgggaataaacactgcccatcaaacaggaatgattgcccaggaggtgcaagaaatcctgcccagagcagtaagagaggttggtgatgtcacctgcggaaacggagagaccttggagaacttcctcatggtggataaggaccagatctttatggaaaatgtaggtgcagtgaagcaactgtgcaaactaactaacaaccttgaggaaagaatagaagagttagaaatatggaacagaaagctggcccggctaaagcggctcagtagttggaagtcatcagccagtgaagcaagcacaatcagcaaatctagcagagccgttagtgcatcttctccaagaagggccgttcataaaaaaaacaacaaggtttatttttcaggaaaaagacaggcgtgtcctaattgggttttccagaccttggttataactctgattgctgtgatggcattttgcttaaaagatcaagaccgacgtgtcccaaatctccctccaagcaatatcacaagctcacaggagccagctctgctgcccacagcctcctcctcagcacctaatacatccctggtaaccacaccggcctccttacaagtacctgaaattactttctgtgaaatcctgccgtgtcaggagacttattgctgccccatccggggaatgaaagaagtctcttcaagtcctgtgcaaagacaatctgaggagaaggaattccatcagaggcgatggtcagacaaaagcaaatcagttttggcaagaaatgcactcagcggccctgactgggagagtgactggattgatacaaccatcagttctattcagattatggaaatccagcaaataatagatcatcagtattgcattcaaagcctccagtgcggatctggaaattataattacaatattcctgttaataaacacacacccaccaatgtcaagttctctctggaaataaacacaacagagccattgatagtcttccagtgcaaattcacccttggaaatatatgtttccatagtaaaaggggaaccaaagggctggaaagccacagagaaatctcccaggagatgacacagggatatcagcacatttggagcctccctgtagccccattttctgacagcatgttccatttccgtgtagctgcaccggatttagctgactgttcaactgatccttattttgctgggatattcttcaccgattacttcttttacttctatcgacgctgtgcctaatttgttcaagtttggggactttaccaaagaaaaatactcaggaatacatttaacagaaacgaacatcctcttgcaacttcttttttcttctttgtaaaacatttacgtttattgctgaaggactttttcaggctttagcttccaacagttttgagacattaatgaggagaataaaatgtttgctgaaacttgaaataatgtgatgtttgattttgccatgactatgaagaaaacatttcctggagcaaacagttctgttgaatttaaaaatactattatttctggtattaaggaagttgtgagctcaaaataaggagatctagcctctattttgttttaatgtattttaaagcttttgaaaaaaccaaaagggccatgtcgacttcggcccactaaacatagactcttgagaatgtgtgatatggtatgtggaggagatgtggggggtggtatctgatactgagctcacatttaggcaaattgtcctatgtgtgtgtgtattgtataaacacatacactagagtacagaatgtagtttgttaatcaaatggatttaagagaaataa

SEQ ID NO: 156442 - DNA, 5535 bp, Homo sapiens
  Payload ID: 10673
  Gene Symbol: MYT1
  Gene Name: myelin transcription factor 1
  Uniprot ID: Q01538
  ENST ID: ENST00000328439
  CDS Start-End: 365-3730
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgatgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtgaa

SEQ ID NO: 156443 - DNA, 2061 bp, Homo sapiens
  Payload ID: 10673
  Gene Symbol: MYT1
  Gene Name: myelin transcription factor 1
  ENST ID: ENST00000360149
  CDS Start-End: 219-1994
cggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcaggtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtacgttgggccatgctggctctttcattgcattgcggaattgagattttcgtgtgttttataatgtaaaaaaactcctactagattcccttttcattaatacaacgggtcacctaactgaccaacgccaa

SEQ ID NO: 156444 - DNA, 5614 bp, Homo sapiens
  Payload ID: 10673
  Gene Symbol: MYT1
  Gene Name: myelin transcription factor 1
  Uniprot ID: Q01538
  ENST ID: ENST00000536311
  CDS Start-End: 365-3811
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgatgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtg

SEQ ID NO: 156445 - DNA, 5535 bp, Homo sapiens; identical to SEQ ID NO: 156442
  Payload ID: 10673
  Gene Symbol: MYT1
  Gene Name: myelin transcription factor 1
  Uniprot ID: Q01538
  ENST ID: ENST00000613234
  CDS Start-End: 365-3730

SEQ ID NO: 156446 - DNA, 2140 bp, Homo sapiens
  Payload ID: 10673
  Gene Symbol: MYT1
  Gene Name: myelin transcription factor 1
  ENST ID: ENST00000621996
  CDS Start-End: 365-2140
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcaggtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtacgttgggccatgctggctctttcattgcattgcggaattgagattttcgtgtgttttataa

SEQ ID NO: 156447 - DNA, 2140 bp, Homo sapiens; identical to SEQ ID NO: 156446
  Payload ID: 10673
  Gene Symbol: MYT1
  Gene Name: myelin transcription factor 1
  ENST ID: ENST00000622439
  CDS Start-End: 365-2140

SEQ ID NO: 156448 - DNA, 2061 bp, Homo sapiens; identical to SEQ ID NO: 156443
  Payload ID: 10673
  Gene Symbol: MYT1
  Gene Name: myelin transcription factor 1
  ENST ID: ENST00000616597
  CDS Start-End: 219-1994

SEQ ID NO: 156449 - DNA, 5614 bp, Homo sapiens; identical to SEQ ID NO: 156444
  Payload ID: 10673
  Gene Symbol: MYT1
  Gene Name: myelin transcription factor 1
  Uniprot ID: Q01538
  ENST ID: ENST00000616648
  CDS Start-End: 365-3811

SEQ ID NO: 156450 - DNA, 670 bp, Homo sapiens
  Payload ID: 10674
  Gene Symbol: MYT1L
  Gene Name: myelin transcription factor 1-like
  ENST ID: ENST00000399157
  CDS Start-End: 1-609
gaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggaggatggtgtatggtgggggcaataaatgaggttttttgcattccaaggaaatggcatatggattaactgtaagaaatgaaataagt

SEQ ID NO: 156451 - DNA, 7063 bp, Homo sapiens
  Payload ID: 10674
  Gene Symbol: MYT1L
  Gene Name: myelin transcription factor 1-like
  Uniprot ID: Q9UL68
  ENST ID: ENST00000399161
  CDS Start-End: 749-4309
ggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgatgagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacgaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttccccggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtgggggcaataaatgaggttttttgcattccaaggaaatggcatatggattaactgtaagaaatgaaataagtaatttattgtaagacaacatcaagccatggaaacttggcagaagattcaaagcagcttaaacagcacttttaaattaactcctaagcgttacatggttgtgactatggaaactccagttaagacaggatcttatcagaggtggacaacgtgaagatttccttttccattttcaataaactttggaacaaccttctcgtatctcccctagagtttcgtgcccctctgaactgtctgttattgcaatgtagtttatcaacagaatttgtgtgttttcgatttaagctaaaagataatttaagaacatttatttccccttttcactttaaaaaattatgattattcctattattgttatgaaccttcttattttacatttgagggataaaggcaaatgatttgtgagtcttctagttactggaccgagttttctgctggatctggtgggaaggcagctcggtaaagtttccctcctgctccccccgcccgactttgactctgaatcagcatttggtcctattcagaggactcttaccacgacgtttctgttctacacttgggtggagaccagttgaccatagagcatttgcagagcctcattgtttgatttcttgtgactattctaagaatgaatgcaatcagattttaaaagtaactaaatatacttcagcacttttttgctttaaactagatcatcttagacttgtttataccttccagatttgattgttttactcccaatgactgcactatatgtatgcataagaccacttttgagcgctgtgttcccccttctgagtagtcctttgacgacgtgttgtgttttctgatgttgacttgagttccatttagtagcatctcttccttccatgtcttgatgttatgcaggaagtacagacgtactttaaatttttgttatgaaataaaaaaaagatgggttttgtaaaaataaaaaaaaaatatttttagcagaacaggacttacagggtcattgtccccacaatgtgccagtcgactatttgcacttaccttgtcctatatatccgtacggaggtgtgcaattcctcgtgtcagtagccttgtgacactgaacctggatggattatagaggagccctcacggctgatcaataatgttgcaaagggagactacagggatctcacgacgaatattctgatacaatactcaacctcggtatatatatatgtgtataaatatatgtatatcccagcggcactttatactgttcactgtacaaaagcttacagttttccacaaggactttaataactagctgggaaaagacgatgtaattatttcggggctctgcggaaccttctctgtacagcgccccctttctgttgtgctattggttgcagctgccatgctcagaatgcgttttgagagctgaagcaaggtgcttgcagtcacctgaggccgtccgtgtggcccagggccccagctgcctttagggcccccattgttcataacagcatatgcatttccccaccgcgttgtgtctgcagcttctttgccaatatagtaatgcttttagtagagtactagatagtatcagttttggattcttattgttatcacctatgtacaatggaaagggattttaagcacaaacctgctgctcatctaacgttggtacataatctcaaatcaaaagttatctgtgactattatatagggatcacaaaagtgtcacatattagaatgctgacctttcatatggattattgtgagtcatcagagtttattataacttattgttcatattcatttctaagttaatttaagtaatcatttattaagacagaattttgtataaactatttattgtgctctctgtggaactgaagtttgatttatttttgtactacacggcatgggtttgttgacactttaattttgctataaatgtgtggaatcacaagttgctgtgatacttcatttttaaattgtgaactttgtacaaattttgtcatgctggatgttaacacatcttactctaaataaacaaggtgttgccacatttgtagcacgaaggatctctaa

SEQ ID NO: 156452 - DNA, 3642 bp, Homo sapiens
  Payload ID: 10674
  Gene Symbol: MYT1L
  Gene Name: myelin transcription factor 1-like
  Uniprot ID: Q9UL68
  ENST ID: ENST00000407844
  CDS Start-End: 357-911
aagcgcctggaagcggaagctggacagacgaggagaggccttgggtgtgacatcaacggaacctgagggaagcaaaactcagcaaggacgcacccggtctgctggactggggctttggcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcaggtaacaattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtgggggcaataaatgaggttttttgcattccaaggaaatggcatatggattaactgtaagaaatgaaataagtaatttattgtaagacaacatcaagccatggaaacttggcagaagattcaaagcagcttaaacagcacttttaaattaactcctaagcgttacatggttgtgactatggaaactccagttaagacaggatcttatcagaggtggacaacgtgaagatttccttttccattttcaataaactttggaacaaccttctcgtatctcccctagagtttcgtgcccctctgaactgtctgttattgcaatgtagtttatcaacagaatttgtgtgttttcgatttaagctaaaagataatttaagaacatttatttccccttttcactttaaaaaattatgattattcctattattgttatgaaccttcttattttacatttgagggataaaggcaaatgatttgtgagtcttctagttactggaccgagttttctgctggatctggtgggaaggcagctcggtaaagtttccctcctgctccccccgcccgactttgactctgaatcagcatttggtcctattcagaggactcttaccacgacgtttctgttctacacttgggtggagaccagttgaccatagagcatttgcagagcctcattgtttgatttcttgtgactattctaagaatgaatgcaatcagattttaaaagtaactaaatatacttcagcacttttttgctttaaactagatcatcttagacttgtttataccttccagatttgattgttttactcccaatgactgcactatatgtatgcataagaccacttttgagcgctgtgttcccccttctgagtagtcctttgacgacgtgttgtgttttctgatgttgacttgagttccatttagtagcatctcttccttccatgtcttgatgttatgcaggaagtacagacgtactttaaatttttgttatgaaataaaaaaaagatgggttttgtaaaaataaaaaaaaaatatttttagcagaacaggacttacagggtcattgtccccacaatgtgccagtcgactatttgcacttaccttgtcctatatatccgtacggaggtgtgcaattcctcgtgtcagtagccttgtgacactgaacctggatggattatagaggagccctcacggctgatcaataatgttgcaaagggagactacagggatctcacgacgaatattctgatacaatactcaacctcggtatatatatatgtgtataaatatatgtatatcccagcggcactttatactgttcactgtacaaaagcttacagttttccacaaggactttaataactagctgggaaaagacgatgtaattatttcggggctctgcggaaccttctctgtacagcgccccctttctgttgtgctattggttgcagctgccatgctcagaatgcgttttgagagctgaagcaaggtgcttgcagtcacctgaggccgtccgtgtggcccagggccccagctgcctttagggcccccattgttcataacagcatatgcatttccccaccgcgttgtgtctgcagcttctttgccaatatagtaatgcttttagtagagtactagatagtatcagttttggattcttattgttatcacctatgtacaatggaaagggattttaagcacaaacctgctgctcatctaacgttggtacataatctcaaatcaaaagttatctgtgactattatatagggatcacaaaagtgtcacatattagaatgctgacctttcatatggattattgtgagtcatcagagtttattataacttattgttcatattcatttctaagttaatttaagtaatcatttattaagacagaattttgtataaactatttattgtgctctctgtggaactgaagtttgatttatttttgtactacacggcatgggtttgttgacactttaattttgctataaatgtgtggaatcacaagttgctgtgatacttcatttttaaattgtgaactttgtacaaattttgtcatgctggatgttaacacatcttactctaaataaacaaggtgttgccaca

SEQ ID NO: 156453 - DNA, 4850 bp, Homo sapiens
  Payload ID: 10674
  Gene Symbol: MYT1L
  Gene Name: myelin transcription factor 1-like
  Uniprot ID: Q9UL68
  ENST ID: ENST00000428368
  CDS Start-End: 671-4225
tttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgatgagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacgaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttccccggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatgatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtggggg

SEQ ID NO: 156454 - DNA, 1848 bp, Homo sapiens
  Payload ID: 10674
  Gene Symbol: MYT1L
  Gene Name: myelin transcription factor 1-like
  ENST ID: ENST00000602387
  CDS Start-End: 1-1032
caggagaggaatccgcagcagaacatgaacatccgtcagcatgtccggccagaagaggacttccccggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaagcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagacattcttgatcatggacaaaacaaattttccagataaactctcgctcttggatcctctaagctcttaaacttcctgagataacactttgcctggtcttacccaaagcagcaaacatgggacgttttgaaaagaaaatccatcacttcattgtctaattatgtataatatgtaaactgaaactggattaaaatttaacgtgcacctgaatctta

SEQ ID NO: 156455 - DNA, 3388 bp, Homo sapiens
  Payload ID: 10675
  Gene Symbol: MOBP
  Gene Name: myelin-associated oligodendrocyte basic protein
  Uniprot ID: Q13875
  ENST ID: ENST00000311042
  CDS Start-End: 150-770
aaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagctcctgccagcgtcgcttaagcagcagaggagagccctggctcccgcctccagcttcttttggccctctcagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggaggtgagcagggctatctctgtgtgttgtactccagtcagggggttccagcagcacccgcaggctctagagctcaatgcacagttctttttgtttcacctgcagtcctttcttctccaggatatgcacaggcctccagggtctttcatggctcagggtcagggtggctcaagtgccaacccacatgttgtcctccaaatattcccttctatccctggcatgctgttgctgagctcaacttttaatttttgactttctcctttgtaattaatctctatctgggtttctctctttctctgtgccatttggtttccttaattagttccctgtgccagcccatagtcagagccataattggctctggggaagatccaagttattttctgagtaagatattaggcttccatatgatccagagatgcaaagaaatccctagagagtgtaggagttgtctaaatccatgtgtcagatgtagccaacgaattatgtcagaagcagagagaaaaggcctgaaaagcagctctctcccactcctcaggcccttgtctccaaccttacatgaggctttttgaacatctcctcctggcccagctggggtgagagcaagtcctcgaaggcactgcctttgagccttgctcagcccatctgaactatcccaactctagaattgactgctttcgaattgtgtgaccttgggaatgttatctggcttcaaccacaatgccctacccccagctcctctcccaaatgatcctagatacagggctgcttccccccgaccctaccccacctcgggacacaggctcatggcctcatggcacttcaccaccagaagtggtgctcagagttcctatttccacatctaaccccctaattcctgggaaagtctgaggcctggtccccccagtgctttccctggctggcctctccacattttcatctgatggtggagtgagatcaggaaaaataggacaggagctttgccttgggggagaagagagttaagtgtggaaaggggtgagttataggaggttaagcagtccaagatttctctctctgtgtaggaggccatttcctgatgtgaggggtctgaacccaattatgatgggacagggttgggcattgacttcccatctcttctctctgtttttctcccactatctgtagcccaaaactcttatggaggactttgatctttagtataggctattggtcagggccataggaactaaccccgatcctcactccaccaggatctaccacatcccctacacacaaacacatgctgtggggagggagttttcccctgggtcaagttgaggatccttagatcaccttgtgctcctgtggactggtgtgtgcgtgtgtgtgtgtgtgtgtgtgtgtgtgtgtgtgtgtgtgtgtgtgtgtgtatgttgggaaacttagctttcagagaatgtctatgggctctcattttctctctcacacaaaaatactcgggacttctccaagtccctgaggagcctgaccactgaagctgatcatgagatgactgtatgctgacacacccccttcaggggcctggccttgacttagggctgcactgtatcctcagcaacggccttgcaggagccccttttggactgctttccctattcagcccagagttggggtggtgggagaagaggggttggagtgaatccatctctattcaaattccagctgggattactctaggagtcttcctggcttgttttgggcccaaacttagctacattgtttattggctcccaaagtcgggattgaagagtgaaaagatgcaggcaatgaatccttctgcacactcctccccaacctttccagcgcttttctacttaggaggccagtggaagggaggagaggccatgccctagcccacaggggacaaggttcattgttcttccaggcttggttcactctgcttttgattcagaagctctttccctacccagcaagactacactttcttgccttctttctattttttctttttgtgcgtataaatggtatgttgtgatatattctcagtgcttgtgcccaccttggaactctgttcttgctcttcattccgcatgtgatactctggtccaagatcttggccaggtgccttctgctcaaatatcgtctcagaggtgcttcccttgaaaactcggtgctgtttccatagttactctatttgatcactctaagtttggttgtcttcatagcacttgtcaccctctggaactattctattcatttatttacttgtttaatgcttggctcttttcccctcctaacgtaaactccatgattgccaacacctgtttacttactacagttccccctccccccacattcctgacactagtaagaaccaataaacacttgttgacgg

SEQ ID NO: 156456 - DNA, 3051 bp, Homo sapiens
  Payload ID: 10675
  Gene Symbol: MOBP
  Gene Name: myelin-associated oligodendrocyte basic protein
  Uniprot ID: Q13875
  ENST ID: ENST00000383754
  CDS Start-End: 225-470
aaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggaggtgagcagggctatctctgtgtgttgtactccagtcagggggttccagcagcacccgcaggctctagagctcaatgcacagttctttttgtttcacctgcagtcctttcttctccaggatatgcacaggcctccagggtctttcatggctcagggtcagggtggctcaagtgccaacccacatgttgtcctccaaatattcccttctatccctggcatgctgttgctgagctcaacttttaatttttgactttctcctttgtaattaatctctatctgggtttctctctttctctgtgccatttggtttccttaattagttccctgtgccagcccatagtcagagccataattggctctggggaagatccaagttattttctgagtaagatattaggcttccatatgatccagagatgcaaagaaatccctagagagtgtaggagttgtctaaatccatgtgtcagatgtagccaacgaattatgtcagaagcagagagaaaaggcctgaaaagcagctctctcccactcctcaggcccttgtctccaaccttacatgaggctttttgaacatctcctcctggcccagctggggtgagagcaagtcctcgaaggcactgcctttgagccttgctcagcccatctgaactatcccaactctagaattgactgctttcgaattgtgtgaccttgggaatgttatctggcttcaaccacaatgccctacccccagctcctctcccaaatgatcctagatacagggctgcttccccccgaccctaccccacctcgggacacaggctcatggcctcatggcacttcaccaccagaagtggtgctcagagttcctatttccacatctaaccccctaattcctgggaaagtctgaggcctggtccccccagtgctttccctggctggcctctccacattttcatctgatggtggagtgagatcaggaaaaataggacaggagctttgccttgggggagaagagagttaagtgtggaaaggggtgagttataggaggttaagcagtccaagatttctctctctgtgtaggaggccatttcctgatgtgaggggtctgaacccaattatgatgggacagggttgggcattgacttcccatctcttctctctgtttttctcccactatctgtagcccaaaactcttatggaggactttgatctttagtataggctattggtcagggccataggaactaaccccgatcctcactccaccaggatctaccacatcccctacacacaaacacatgctgtggggagggagttttcccctgggtcaagttgaggatccttagatcaccttgtgctcctgtggactggtgtgtgcgtgtgtgtgtgtgtgtgtgtgtgtgtgtgtgtgtgtgtgtgtgtgtgtgtatgttgggaaacttagctttcagagaatgtctatgggctctcattttctctctcacacaaaaatactcgggacttctccaagtccctgaggagcctgaccactgaagctgatcatgagatgactgtatgctgacacacccccttcaggggcctggccttgacttagggctgcactgtatcctcagcaacggccttgcaggagccccttttggactgctttccctattcagcccagagttggggtggtgggagaagaggggttggagtgaatccatctctattcaaattccagctgggattactctaggagtcttcctggcttgttttgggcccaaacttagctacattgtttattggctcccaaagtcgggattgaagagtgaaaagatgcaggcaatgaatccttctgcacactcctccccaacctttccagcgcttttctacttaggaggccagtggaagggaggagaggccatgccctagcccacaggggacaaggttcattgttcttccaggcttggttcactctgcttttgattcagaagctctttccctacccagcaagactacactttcttgccttctttctattttttctttttgtgcgtataaatggtatgttgtgatatattctcagtgcttgtgcccaccttggaactctgttcttgctcttcattccgcatgtgatactctggtccaagatcttggccaggtgccttctgctcaaatatcgtctcagaggtgcttcccttgaaaactcggtgctgtttccatagttactctatttgatcactctaagtttggttgtcttcatagcacttgtcaccctctggaactattctattcatttatttacttgtttaatgcttggctcttttcccctcctaacgtaaactccatgattgccaacacctgtttacttactacagttccccctccccccacattcctgacactagtaagaaccaataaacacttgttgacggaa

SEQ ID NO: 156457 - DNA, 577 bp, Homo sapiens
  Payload ID: 10675
  Gene Symbol: MOBP
  Gene Name: myelin-associated oligodendrocyte basic protein
  Uniprot ID: Q13875
  ENST ID: ENST00000415443
  CDS Start-End: 207-452
aaaaacaccttgtgtaatgaaaaacccagatctataacctctccctatatattctgcatgcattgaagtaggctcaaaccctcagggacctggtatagacgcagaatctgtttcacacaacaactgctatttgaagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtg

SEQ ID NO: 156458 - DNA, 830 bp, Homo sapiens
  Payload ID: 10675
  Gene Symbol: MOBP
  Gene Name: myelin-associated oligodendrocyte basic protein
  Uniprot ID: Q13875
  ENST ID: ENST00000441980
  CDS Start-End: 132-683
aaaccctcagggacctggtatagacgcagaatctgtttcacacaacaactgctatttgaagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaaggttagtagttgcttcctgtgtttactaacaccgggctgtctccatggccctcttcagccttattacccaacctgtgtaatcagctccctccattaaatcccctctgtttgaaa

SEQ ID NO: 156459 - DNA, 1340 bp, Homo sapiens
  Payload ID: 10675
  Gene Symbol: MOBP
  Gene Name: myelin-associated oligodendrocyte basic protein
  Uniprot ID: Q13875
  ENST ID: ENST00000424090
  CDS Start-End: 8-559
cagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatcatgagaaattaccaaaatgtccaccaatagaatgagtgaatcacctgtggtatatttataaataaaaatattaaatagaaggtaaaacaaatcag

SEQ ID NO: 156460 - DNA, 940 bp, Homo sapiens
  Payload ID: 10675
  Gene Symbol: MOBP
  Gene Name: myelin-associated oligodendrocyte basic protein
  Uniprot ID: Q13875
  ENST ID: ENST00000420739
  CDS Start-End: 225-776
aaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtgaccaaggaggagtttaaactgaatgaacaacctcggctcctggactcattgcttcacaacccatctacccctggatgaagttatctggctt

SEQ ID NO: 156461 - DNA, 561 bp, Homo sapiens
  Payload ID: 10675
  Gene Symbol: MOBP
  Gene Name: myelin-associated oligodendrocyte basic protein
  Uniprot ID: Q13875
  ENST ID: ENST00000428261
  CDS Start-End: 291-536
aaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatga

SEQ ID NO: 156462 - DNA, 5675 bp, Homo sapiens
  Payload ID: 10675
  Gene Symbol: MOBP
  Gene Name: myelin-associated oligodendrocyte basic protein
  Uniprot ID: Q13875
  ENST ID: ENST00000452959
  CDS Start-End: 126-371
cgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatcatgagaaattaccaaaatgtccaccaatagaatgagtgaatcacctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataatgcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatgaatcaaaactatctgacaattacttgaaatgggtgaatagctaaatgtaatgtgccttggatattataactaaaaggtgctataatccagttatattttttatcttttaaggattggttctgaggagcactaccagtaaatattgcaaaaattacataaagctccaaaagctactctgtgtaaacttcttgagtgggaattctcaaccataatatctggaatatgactgataattctggatgttaactgattttatgttctgatgttttgactggttttgggaaaaattttgggaaaaaagagttttcctcgtaaatacccaacaactgggtctctgggtaaaaaggcctaatttatagagattgctaatttccatggtgtaaatatttccacaatgcagattccttccttccttttttttttttttttttttgagatggagtttcactcttgttacccagactggagtgcaaaggtgcgaccttggctcactgcaatcttcacctcccgggttcaagccattctcctgcctcagcctcccaagtagctgggattacaggtgcccacgaccatgcctggctaattttgtatttttagtagagatagggattcaccatgttggccaggctggtctcaacctctggacctcaggtgatccacccgcctcggcctcctaaagtgctggagattacaggcatgagccaccacgcccggaccatgatgcagatttcaagctatgaacatgattctctggagtttaccatttgtcttttaattggcaaatttgatgcagaattgggaagagaagcacacaattgactctcgtcagctggcacaagctggtgccagtgcaccactgtatatatccatggccctctgtgaagctagagtttactactaaaatttgtgctccataaatatacaaaggcactagtaagagaaaaaatataaagagaatataaactaaattcaaattagggagctcaaatggagaaaattgacagataatatttttgaaactttgaaaagtagtatttgtctagattcaccttttattaccttttcctttttttcttttccttttttttttttttttgagacggagtttctctcttgttacccaggctggagtgcaatggcacgcaatctcagctcattgcaacctcggctcactgtaaccttcaccttccgtgttcaaatgattctcctgcctcagccttccgagtagctgggattacaggcacccaccaccatgcccagctaattctttgtatttttagtggagatggggtttcaccatgttggccaggctggtcttgaacccctgacctcaggtgatccacccacctgggcctcccaaagtgctgggattacaggcatgagccaccgcgcccggcctgttattatcttttattaagcaaacagcgtatctatgtatcatactgagtgttctgagctgttagtttctttggtgttcatctagatggaagctggggcttccttcctttcagatattggtgctaacatgaagctgaccaaagaattgatgggatctgcacactgtaaagccggtttcaggatggctgagctgacggtcaagaaagaagagaagatatgagccgcctgcattttggggtggtggcagtgaaatttagacttgtgatttggtatgacaatatatggctttttgtgattgttaacattaatgaaaacaagaaaaattagttgctcaaaagttgaaaaatggattcataaactttttattagagtaaggcaaaagaacatattaaaatagaggtaaattagaaatgtcaataagaacccatggacattttttataaggagactttatctgttctgtccctacagtgatttatgctcttggatatttttgctgtcatcctgacaaattctagttggaatatggaacaagcttatttgtagacctagtgcctgtggcttctaaagcaattttctgaaaagagaaaccactgcctgttggaagaatagttgattccatacctcaagctagggaaaaaaaatcagaattagtctgtgaattctagatgttgagagaaagcagggtttcattagggcatcggagagtcacaagtccataggatgcaaaaaggaagatgaaataaaattgcctgaaaaacgcacctgaatttctggcattgtttactgaaaaggctgtgtattgatgaaccccaattatgtgaggtctacatttaagagtttataatcaacagtttgaaaatgcagggtgttgtttctttctataaggagacaaaacagtcagaagggagtgtcacaggacattatcacaaaatcaaagttctccatgaaatgtggttcatttgctagaaaataatgcaagcctattggagagaatcagggcttctagtgatgctagggatgaccttaagcattgtttgtaaatcacactttttcctagtctttcagcagcagctgcacagagtaggcctgcttcttcccatgaaagccacactgagttttatcaactagtagtgtgtgggcactattgcaagttatgttgtgttgtttatggccatttatccaacagtgctttcctctgtgcggggctctgcagcctcgttctatgttatttttattaccacgtgtctgtgcgcctcaggtggcaaagcagaatcagcttctctaccctcagcagggctcactatgactcactataagggaagaaaatcttacagatgtcagaaaatgttaggtaagtggacagtgataaacacaaaacagcaagtggtcagtatcaaagagaaaaacagtatgttggtgaaggagaagtatcaaagctagttaaaaaagtaacaggagaaatgtaaagggacaatactccacaaaaatttagattgtaactgagcttcttctcctaaagagatttaaaaataaagtataggaaatacatgaagaaacaaagtaaaatgccaaggtgtaagtttgaccatgaatatctagggaaaaacatacttgcactaaaacaaccaaatatgcaaaaatcaagtggaaaaacaggtcaaaataatgccagttgatgtctgtaagaactaaatgtataataaaatgagcaaaaaaaa

SEQ ID NO: 156463 - DNA, 571 bp, Homo sapiens
  Payload ID: 10675
  Gene Symbol: MOBP
  Gene Name: myelin-associated oligodendrocyte basic protein
  ENST ID: ENST00000436143
  CDS Start-End: 384-571
aaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacaggtatcagtcattcccaagccctcatctttggccagatgaaatgcctctgcccatgaagtttcaccttgttctctagcccaacatattgccctctcttctgtggacttttcatgccattgcaccagcacattctcatgttgcagagcatgctggccttgtatgacactcactgatgtctgtggacattcctctacctacaagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgctt

SEQ ID NO: 156464 - DNA, 566 bp, Homo sapiens
  Payload ID: 10675
  Gene Symbol: MOBP
  Gene Name: myelin-associated oligodendrocyte basic protein
  Uniprot ID: Q13875
  ENST ID: ENST00000447324
  CDS Start-End: 141-386
aaaaacaccttgtgtaatgaaaaacccagatctataacctctccctatatattctgcatgcattgaagtaggctcaaaccctcagggacctggtatagacgcagaatctgtttcacacaacaactgctatttgaagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcct

SEQ ID NO: 156465 - DNA, 567 bp, Homo sapiens
  Payload ID: 10675
  Gene Symbol: MOBP
  Gene Name: myelin-associated oligodendrocyte basic protein
  ENST ID: ENST00000451925
  CDS Start-End: 393-567
gtggtttggtagggtgagctggtgtgtggtgtggttggacctggcatggaacttaactggagtttatgtggaatgaaccttgagggccttttgtttaaactttgtgtggcctttttgtagtctttgtgtagcttttgtttttaagtggatcttcgctgaggactcatcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggagg

SEQ ID NO: 156466 - DNA, 911 bp, Homo sapiens
  Payload ID: 10675
  Gene Symbol: MOBP
  Gene Name: myelin-associated oligodendrocyte basic protein
  Uniprot ID: Q13875
  ENST ID: ENST00000442631
  CDS Start-End: 5-553
tgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtg

SEQ ID NO: 156467 - DNA, 1029 bp, Homo sapiens
  Payload ID: 10676
  Gene Symbol: MDS2
  Gene Name: myelodysplastic syndrome 2 translocation associated
  Uniprot ID: Q8NDY4
  ENST ID: ENST00000374555
  CDS Start-End: 588-1010
gtactagctgtcagctgctggagaccttgctttctgtttcactgggaaacagaagcaatcagaaggaaacttcctcagactccacctctcccttcactcccgcctgtatccgtgcctgttacctggacgccttgtggaacttgaattctacgccctccactgggacactgcccttcatcctctctcacctcctccaggacaacactctctctgtggggctttcacccccatcgctccactgaaactgctcttgtcaaggtcatcgatgacctcccgctgacaaactcaactgtcccatctctacaccccaaactgacccatcaggaatagcatgagctccaccttccaaagcttccgcaatctcaccgtctccaccgttactacctgtgtccgaggcaccactgtttcttgcctggagttgtagacgggatttcaccgtgttagccaggatggtctcgatctcctgacctcgtgatccgcctgtctcgacctcccaaagtgctgggattacagaatgttgtagtcctcatcatcagcagagactttgtgccatcctctgctatattatcctgaagagtgcctggctcatgctccaggctgcggattttattgagagaacggagactgctggtgaactctcaagagggttaattggagttttatcaagccagatttcatggtgtctgcttaatgttaatctctccaagcttcccaccagactgcaaaggctgagctgcagtgttctgaatagcagtccagctatgaggggaggtgcccgtggcaggcctcagctgaccctggagaggccattaagacctggctgtcgcctccacagctgctcggaggcagagaaaggtggctttgtaagaagaaaagagatcattctttttccaccatgtgaggacccagcaagagggtggctgtctgcaaacccagggagagagccctcaccaggaatctgctggcaccttaatcttggacttcccagcctccacaactgtgaggaataaatgtatgttgtttaagcca

SEQ ID NO: 156468 - DNA, 420 bp, Homo sapiens
  Payload ID: 10676
  Gene Symbol: MDS2
  Gene Name: myelodysplastic syndrome 2 translocation associated
  ENST ID: ENST00000612756
  CDS Start-End: 1-420
ctccaggctgcggattttattgagagaacggagactgctggtgaactctcaagagggttaattggagttttatcaagccagatttcatggtgtctgcttaatgttaatctctccaagcttcccaccagactgcaaaggctgagctgcagtgttctgaatagcagtccagctatgaggggaggtgcccgtggcaggcctcagctgaccctggagaggccattaagacctggctgtcgcctccacagctgctcggaggcagagaaaggtggctttgtaagaagaaaagagatcattctttttccaccatgtgaggacccagcaagagggtggctgtctgcaaacccagggagagagccctcaccaggaatctgctggcaccttaatcttggacttcccagcctccacaactgtgaggaataa

SEQ ID NO: 156469 - DNA, 1110 bp, Homo sapiens
  Payload ID: 10677
  Gene Symbol: MCL1
  Gene Name: myeloid cell leukemia 1
  Uniprot ID: Q07820
  ENST ID: ENST00000307940
  CDS Start-End: 1-816
atgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaattt

SEQ ID NO: 156470 - DNA, 3932 bp, Homo sapiens
  Payload ID: 10677
  Gene Symbol: MCL1
  Gene Name: myeloid cell leukemia 1
  Uniprot ID: Q07820
  ENST ID: ENST00000369026
  CDS Start-End: 61-1113
tccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaata

SEQ ID NO: 156471 - DNA, 3626 bp, Homo sapiens
  Payload ID: 10677
  Gene Symbol: MCL1
  Gene Name: myeloid cell leukemia 1
  ENST ID: ENST00000620947
  CDS Start-End: 209-802
gcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaatacaggg

SEQ ID NO: 156472 - DNA, 1752 bp, Homo sapiens
  Payload ID: 10678
  Gene Symbol: MNDA
  Gene Name: myeloid cell nuclear differentiation antigen
  Uniprot ID: P41218
  ENST ID: ENST00000368141
  CDS Start-End: 262-1485
attacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtgtgtggaagtcacagcttcatcaaggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggaca

SEQ ID NO: 156473 - DNA, 582 bp, Homo sapiens
  Payload ID: 10678
  Gene Symbol: MNDA
  Gene Name: myeloid cell nuclear differentiation antigen
  ENST ID: ENST00000438394
  CDS Start-End: 1-313
cccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggacatt

SEQ ID NO: 156474 - DNA, 2850 bp, Homo sapiens
  Payload ID: 10679
  Gene Symbol: MYD88
  Gene Name: myeloid differentiation primary response 88
  ENST ID: ENST00000396334
  CDS Start-End: 185-1114
agattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 156475 - DNA, 1279 bp, Homo sapiens
  Payload ID: 10679
  Gene Symbol: MYD88
  Gene Name: myeloid differentiation primary response 88
  ENST ID: ENST00000424893
  CDS Start-End: 111-905
gcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtagga

SEQ ID NO: 156476 - DNA, 914 bp, Homo sapiens
  Payload ID: 10679
  Gene Symbol: MYD88
  Gene Name: myeloid differentiation primary response 88
  Uniprot ID: Q99836
  ENST ID: ENST00000443433
  CDS Start-End: 2-616
aatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctgggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacattt

SEQ ID NO: 156477 - DNA, 2687 bp, Homo sapiens
  Payload ID: 10679
  Gene Symbol: MYD88
  Gene Name: myeloid differentiation primary response 88
  ENST ID: ENST00000421516
  CDS Start-End: 1-951
cgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggttggctagaaggccacggggtgggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 156478 - DNA, 2871 bp, Homo sapiens
  Payload ID: 10679
  Gene Symbol: MYD88
  Gene Name: myeloid differentiation primary response 88
  ENST ID: ENST00000417037
  CDS Start-End: 185-1138
agattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggttggctagaaggccacggggtgggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttgg

SEQ ID NO: 156479 - DNA, 976 bp, Homo sapiens
  Payload ID: 10679
  Gene Symbol: MYD88
  Gene Name: myeloid differentiation primary response 88
  Uniprot ID: Q99836
  ENST ID: ENST00000495303
  CDS Start-End: 6-485
agacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtg

SEQ ID NO: 156480 - DNA, 2203 bp, Homo sapiens
  Payload ID: 10680
  Gene Symbol: MLF1
  Gene Name: myeloid leukemia factor 1
  Uniprot ID: P58340
  ENST ID: ENST00000355893
  CDS Start-End: 139-945
ctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatgtaaaactctttaaaacatactaattttttaaagcttatatgcttatttcgcttccccagttgtttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgttgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgttttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattca

SEQ ID NO: 156481 - DNA, 2222 bp, Homo sapiens
  Payload ID: 10680
  Gene Symbol: MLF1
  Gene Name: myeloid leukemia factor 1
  Uniprot ID: P58340
  ENST ID: ENST00000359117
  CDS Start-End: 237-968
gcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatgtaaaactctttaaaacatactaattttttaaagcttatatgcttatttcgcttccccagttgtttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgttgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgttttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaa

SEQ ID NO: 156482 - DNA, 2157 bp, Homo sapiens
  Payload ID: 10680
  Gene Symbol: MLF1
  Gene Name: myeloid leukemia factor 1
  Uniprot ID: P58340
  ENST ID: ENST00000392822
  CDS Start-End: 1-900
atgttaaaagaagttcttcagagagaaggaaaatcatacaagtcagaaactctgatgtacattaaaaaagcaagagcatcagagaataagttaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatgtaaaactctttaaaacatactaattttttaaagcttatatgcttatttcgcttccccagttgtttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgttgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgttttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattc

SEQ ID NO: 156483 - DNA, 1050 bp, Homo sapiens
  Payload ID: 10680
  Gene Symbol: MLF1
  Gene Name: myeloid leukemia factor 1
  Uniprot ID: P58340
  ENST ID: ENST00000482628
  CDS Start-End: 303-1034
gtactggaggctagctcttgtcgcggccgcggcgagttaacatcgtttttccaatctgtccgcggctgccgccacccaagacagagccagaatgttcaggatgctgaacagcagttttgaggatgaccccttcttctcagctaaccttgtttgtgaagggactccgctttctgtcaaaactagaaataggacagggaagctgatggggcggggcggggggaggggggcgggaggagggcggcgggggggggggggtgtgtatttaacacctcagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttga

SEQ ID NO: 156484 - DNA, 653 bp, Homo sapiens
  Payload ID: 10680
  Gene Symbol: MLF1
  Gene Name: myeloid leukemia factor 1
  ENST ID: ENST00000466246
  CDS Start-End: 41-653
caatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaa

SEQ ID NO: 156485 - DNA, 1372 bp, Homo sapiens
  Payload ID: 10680
  Gene Symbol: MLF1
  Gene Name: myeloid leukemia factor 1
  Uniprot ID: P58340
  ENST ID: ENST00000478894
  CDS Start-End: 397-1173
gtttttccaatctgtccgcggctgccgccacccaagacagagccagaatgttcaggatgctgaacagcagttttgaggatgaccccttcttctcagaccatgcaagcaagaagagaatggcatgaaatatataaagtgttgagaggaaaaaaacccactgacctagaattctgtatcctgcaaaattatcctttaaaagtcaagaagaaatagactgtctcagacaaacaaaaatttggtgaatttgttgacagtagacctgccttgcaagaaatgttaaaagaagttcttcagagagaaggaaaatcatacaagtcagaaactctgatgtacattaaaaaagcaagagcatcagagaataagttaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtg

SEQ ID NO: 156486 - DNA, 1247 bp, Homo sapiens
  Payload ID: 10680
  Gene Symbol: MLF1
  Gene Name: myeloid leukemia factor 1
  Uniprot ID: P58340
  ENST ID: ENST00000484955
  CDS Start-End: 321-1052
gggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaa

SEQ ID NO: 156487 - DNA, 1098 bp, Homo sapiens
  Payload ID: 10680
  Gene Symbol: MLF1
  Gene Name: myeloid leukemia factor 1
  Uniprot ID: P58340
  ENST ID: ENST00000469452
  CDS Start-End: 299-901
agtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatg

SEQ ID NO: 156488 - DNA, 473 bp, Homo sapiens
  Payload ID: 10680
  Gene Symbol: MLF1
  Gene Name: myeloid leukemia factor 1
  ENST ID: ENST00000487838
  CDS Start-End: 41-163
caatctgtccgcggctgccgccacccaagacagagccagaatgttcaggatgctgaacagcagttttgaggatgaccccttcttctcacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccg

SEQ ID NO: 156489 - DNA, 707 bp, Homo sapiens
  Payload ID: 10680
  Gene Symbol: MLF1
  Gene Name: myeloid leukemia factor 1
  ENST ID: ENST00000498592
  CDS Start-End: 142-707
ggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaag

SEQ ID NO: 156490 - DNA, 750 bp, Homo sapiens
  Payload ID: 10680
  Gene Symbol: MLF1
  Gene Name: myeloid leukemia factor 1
  ENST ID: ENST00000477042
  CDS Start-End: 227-750
gagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcat

SEQ ID NO: 156491 - DNA, 742 bp, Homo sapiens
  Payload ID: 10680
  Gene Symbol: MLF1
  Gene Name: myeloid leukemia factor 1
  ENST ID: ENST00000495452
  CDS Start-End: 108-260
gagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagt

SEQ ID NO: 156492 - DNA, 1266 bp, Homo sapiens
  Payload ID: 10680
  Gene Symbol: MLF1
  Gene Name: myeloid leukemia factor 1
  Uniprot ID: P58340
  ENST ID: ENST00000471745
  CDS Start-End: 300-1076
gagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttc

SEQ ID NO: 156493 - DNA, 787 bp, Homo sapiens
  Payload ID: 10680
  Gene Symbol: MLF1
  Gene Name: myeloid leukemia factor 1
  ENST ID: ENST00000491767
  CDS Start-End: 213-787
ctatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctccatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaa

SEQ ID NO: 156494 - DNA, 2290 bp, Homo sapiens
  Payload ID: 10680
  Gene Symbol: MLF1
  Gene Name: myeloid leukemia factor 1
  Uniprot ID: P58340
  ENST ID: ENST00000619577
  CDS Start-End: 257-1033
tatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatgtaaaactctttaaaacatactaattttttaaagcttatatgcttatttcgcttccccagttgtttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgttgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgttttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattc

SEQ ID NO: 156495 - DNA, 2116 bp, Homo sapiens
  Payload ID: 10680
  Gene Symbol: MLF1
  Gene Name: myeloid leukemia factor 1
  Uniprot ID: P58340
  ENST ID: ENST00000618075
  CDS Start-End: 257-859
tatcccggcgggcaccgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactcatacagatgtcagctctttccagacaatggaccaaatggtgtcaaatatgagaaactatatgcagaaattagaaagaaacttcataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttcaacaatgtgagtaaattgagtctatttaatgtaaaactctttaaaacatactaattttttaaagcttatatgcttatttcgcttccccagttgtttttgtgttggctaaatattcttttatatttatcaagattgattgcagagcagttctatcacttataattagttataagaaattataatgttaaaaaagtctcagtttttactaacactgtactagggtgatattaataaaggtttaaataatttatctctaattttataatgtgttgtaaagccaactagcttaaaactttaaaaataataaagcaaaactacactagtactcttttatgagaaaatagttactattttgataaagggcaaggataatcaaatagttcattttcagagaaaaatattttaaattgctaatgtacatgattgttttggttataatttatttatagaatgtatcttttctatattacattcttaatattcaccagatattatattgaccattctctttaacttcttaatgtggcatatttctactctcctttcccacaaacagcttcatctgtctccaaggttaacattctgaagctggagagtccttggagaaactctgctcagcttttttgtgacatttagaaaaatgcatttggtattctccaaaccagaatgatacattgtctcaaaatctgttagacagctgatgggtgtttttgagcaacgtcttaataattcagttgtttctgttttaattataccattaaaaatcagctttagctttttaattctagaatttaagcatcagtctgttcttataaaagttaggtttgaagtttataagaatataaaatcttaactcacatttgttgtttaatatttctgtcaaggaaaaaagcccccaaaaattgctatcactctataatcctaagtatttttcttttcaattttgtaagtaaaattatatgactatgttcatacttctctaattttttatataatatttttgttaattttactagtttgtgttttatgcctttagtcattaaaataaaatgcaaatgtgttaattc

SEQ ID NO: 156496 - DNA, 1969 bp, Homo sapiens
  Payload ID: 10681
  Gene Symbol: MLF2
  Gene Name: myeloid leukemia factor 2
  Uniprot ID: Q15773
  ENST ID: ENST00000203630
  CDS Start-End: 646-1392
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 156497 - DNA, 1379 bp, Homo sapiens
  Payload ID: 10681
  Gene Symbol: MLF2
  Gene Name: myeloid leukemia factor 2
  Uniprot ID: Q15773
  ENST ID: ENST00000435120
  CDS Start-End: 64-810
agccccggacgggagcgggcccacggggctgcaggtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatgg

SEQ ID NO: 156498 - DNA, 838 bp, Homo sapiens
  Payload ID: 10681
  Gene Symbol: MLF2
  Gene Name: myeloid leukemia factor 2
  Uniprot ID: Q15773
  ENST ID: ENST00000542154
  CDS Start-End: 64-810
agccccggacgggagcgggcccacggggctgcaggtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgta

SEQ ID NO: 156499 - DNA, 851 bp, Homo sapiens
  Payload ID: 10681
  Gene Symbol: MLF2
  Gene Name: myeloid leukemia factor 2
  ENST ID: ENST00000537126
  CDS Start-End: 160-851
aggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcggggtgagttggggagccctcctgtcccagagaagatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctggg

SEQ ID NO: 156500 - DNA, 582 bp, Homo sapiens
  Payload ID: 10681
  Gene Symbol: MLF2
  Gene Name: myeloid leukemia factor 2
  ENST ID: ENST00000536207
  CDS Start-End: 345-582
catctagaacggtgtcgtcggcgggaggaggggagagtatgctaccggccagagctttgggaagaggatggctctgagtgggggagggaaaaaccgagagggttggaaaaattttccatggccctaattgagaaagaggtttgaagagcccttccctccctagagggttgtgtggaacacctggagtagggtctccctggagtttagggggtcagttacaggatttggaaaggacagtgctctgagagtccccacactgagtgggtgtgcaaaaccctggccacctccaagtatctgagcttccatatctttccagtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgt

SEQ ID NO: 156501 - DNA, 458 bp, Homo sapiens
  Payload ID: 10681
  Gene Symbol: MLF2
  Gene Name: myeloid leukemia factor 2
  ENST ID: ENST00000540710
  CDS Start-End: 95-458
atggggcggaggacctgcacttggcattctcatctagaacggtgtcgtcggcgggaggaggggagatgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctacc

SEQ ID NO: 156502 - DNA, 1110 bp, Homo sapiens
  Payload ID: 10681
  Gene Symbol: MLF2
  Gene Name: myeloid leukemia factor 2
  Uniprot ID: Q15773
  ENST ID: ENST00000539187
  CDS Start-End: 364-1110
gcgaacggatggggccggggaagggagctgatgagggcgaggacagctcgacgcaatgccatgcaatgcccagcctcggctttttcgaaggctagtcctgccccgcttctaatttttaggaattcgagattctttcagtgtgtatgcgggaaggggacgatgaagagaaaagaaagctgaaagccagctgaggggagggaacgagaaaacagaggcggccgccgtccggggagagaagcgagcgacggtcgggccgcggggaggggcccggaggagcagcctccagggagagtcctgtttacacttgaggatctcaaaccgcttagcgaggaaagtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtga

SEQ ID NO: 156503 - DNA, 2905 bp, Homo sapiens
  Payload ID: 10682
  Gene Symbol: MZF1
  Gene Name: myeloid zinc finger 1
  Uniprot ID: P28698
  ENST ID: ENST00000215057
  CDS Start-End: 562-2766
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccgctatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaa

SEQ ID NO: 156504 - DNA, 2385 bp, Homo sapiens
  Payload ID: 10682
  Gene Symbol: MZF1
  Gene Name: myeloid zinc finger 1
  Uniprot ID: P28698
  ENST ID: ENST00000594234
  CDS Start-End: 285-1157
gcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccgctatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaa

SEQ ID NO: 156505 - DNA, 2587 bp, Homo sapiens
  Payload ID: 10682
  Gene Symbol: MZF1
  Gene Name: myeloid zinc finger 1
  Uniprot ID: P28698
  ENST ID: ENST00000599369
  CDS Start-End: 244-2448
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccgctatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaa

SEQ ID NO: 156506 - DNA, 1110 bp, Homo sapiens
  Payload ID: 10682
  Gene Symbol: MZF1
  Gene Name: myeloid zinc finger 1
  ENST ID: ENST00000594108
  CDS Start-End: 267-1046
tttcgggaccctccgtaggtacctgccatcttggctatgacccaagtctctcccagggtttcaggttgacttggcaccttgaagagtggaggcttggcccccaggatgaggcggccctcgaaatcgatgccacccacgggggaatgattctgcggtgccatccccttcataaacgcagattccttcctaaagccgcagctgcagaaggaacagcgcgaggagggaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccgctatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccaggtaagtgagatggggtgtggtgggactaggccttccgcatggacagcaccatctctgccgaccccactcctg

SEQ ID NO: 156507 - DNA, 657 bp, Homo sapiens
  Payload ID: 10682
  Gene Symbol: MZF1
  Gene Name: myeloid zinc finger 1
  ENST ID: ENST00000596039
  CDS Start-End: 468-657
ctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagagggtttcaggttgacttggcaccttgaagagtggaggcttggcccccaggatgaggcggccctcgaaatcgatgccacccacgggggaatgattctgcggtgccatccccttcataaacgcagattccttcctaaagccgcagctgcagaaggaacagcgcgaggagggaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccgctatgaggaggccacagggccccaagaggccctggccc

SEQ ID NO: 156508 - DNA, 4507 bp, Homo sapiens
  Payload ID: 10683
  Gene Symbol: MLLT1
  Gene Name: myeloid/lymphoid or mixed-lineage leukemia
  translocated to, 1
  Uniprot ID: Q03111
  ENST ID: ENST00000252674
  CDS Start-End: 165-1844
ggttccgcggggctggcgggcgagcgggcggccgggatcggcggcggcggcggcggcggcggcgcttgacagacaatgagggcggcggggcggcgttgagcggcggcggcggcggcggcggcggcgagcgacgcggggcccgggggcggggcggggcgccagccatggacaatcagtgcaccgtccaggtgaggttagagctggggcatcgcgcccaactgcgcaagaagcccaccacggaggggttcactcacgactggatggtgtttgtccgcggccccgagcaatgtgacatccagcacttcgtggagaaggtggtcttctggctgcacgacagcttccccaagcccagacgcgtgtgcaaggagcccccctacaaagtagaggagtcggggtacgctggcttcatcatgcccatcgaggtgcacttcaaaaacaaggaggagccgaggaaggtctgcttcacctacgacctgttcctgaacctggaaggcaacccgcccgtgaaccacctgcgctgcgagaagctcaccttcaacaaccccaccacggagttccggtacaagctcctgcgggccggcggggtgatggtaatgcccgaaggagcagacacggtgtccaggcccagtcccgactaccccatgttacccacaattccactctctgccttctctgaccccaagaagaccaaaccatcccacggctccaaggacgccaacaaggagagcagcaagacctccaagccacacaaggtgaccaaggagcaccgggagcggccccgcaaagactccgagagcaagagctcctccaaggagctggagcgtgagcaggccaaaagctccaaggacacctcgcggaagctgggcgagggccggctgcccaaggaggagaaggcgccaccgcccaaggctgccttcaaggaacccaagatggccctgaaagagaccaagctggaaagcacgtcccccaagggtgggcccccacccccacccccacccccaccccgggcttccagcaagcggccggccaccgccgactcgccaaagcccagcgccaagaagcagaagaagagcagctcgaaggggtcccggagtgctccaggcacctcgccccgcacctcctcctcctcctccttctcggacaagaagccggccaaggacaagagcagcaccagaggggagaaggtgaaggccgagagtgagccccgggaggccaaaaaggccctggaggtggaggagtccaactcagaggacgaggcctccttcaagtccgagtctgcccagtcaagcccgtccaactccagctccagctcagactccagctcagactcagacttcgagccatcccagaaccacagccaaggacccctgcgctccatggtggaggacctgcagtccgaggagtccgacgaggacgactcttcgtcaggcgaggaggctgccggcaagaccaacccggggagggactccaggttgagcttcagcgacagcgagagtgacaacagcgccgactcctccctgcccagccgtgagcccccacccccccagaagccacccccgcccaacagcaaggtgtcaggccggaggagccccgagtcctgcagcaagcctgagaagatcctcaagaagggcacctacgacaaggcctacacggatgagctggtggagctacaccggaggctgatggcgctgcgggagcgcaacgtgctgcagcagattgtgaatctgatcgaggagactggccacttcaatgtcaccaacaccaccttcgacttcgacctcttctccctggacgagaccaccgtgcgcaaactgcagagctgcctggaggccgtggccacatgaccctgggccgcgtgccgggcccccaccgccggggtcctgggaggctgcagccaggcctcgcctgccctcctctcccgtctcgcctgcccgcagcactgccttagcgacagccctgtcctcgcccgcacagcccgctgcactttcctcggcggctccctgcccactctccccgctccatcgccaggagccctggggccgggctgggccacacgggagccgccccccgggctctctgggctcccctcagagagcggctggtgttgaaggcagctctgggcagagacagggccgggggcccctcgcccagccttgggaccagcccccactgctcggcgggctgtgcggcgtcgctgccccagcctttctgagcagcggatcgacggctggggggcatctccagcctcccgaatggttcagaacacaccctccgcccaccctggacctcagaaggccctgcctgtgtgtctgcgtcgtcctccgtgtagacctagcgccggctcctccccggctcgcgctgcgctggggtctgtgctgtatagttctctctattatatatgtgtgtgcactgtctggtcaagagcagtgtccatgtgcgtttctgtggcagcagtgcacgtggggtgggtggggggtgcgtacggtggggcttgtaggttaagatgtctctgcggtggtgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagcaga

SEQ ID NO: 156509 - DNA, 5032 bp, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENST ID: ENST00000307729
  CDS Start-End: 179-3385
cttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataa

SEQ ID NO: 156510 - DNA, 4850 bp, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENST ID: ENST00000377059
  CDS Start-End: 1-3207
atggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgttt

SEQ ID NO: 156511 - DNA, 5126 bp, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENST ID: ENST00000377072
  CDS Start-End: 349-3432
cgcgcacgcagggctagcctcgcccaggcctcctccctcacgccggccgcaggacgggcgcgcacgccaagtgacgctccgaggaggaagcgcagcccccttcccctccctcgctgcccctggcccagcgggagccccccctccccccagtgcgcctgtgcggaggccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacgacagaggtgacagttctacactaacaaagcaagaacttaaattcataggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataa

SEQ ID NO: 156512 - DNA, 905 bp, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENST ID: ENST00000377091
  CDS Start-End: 177-557
tgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtggcagagtctcgctctgttgcccaggctaaagtgcagtggtgtgatctcagcccactgcaacctctgctccccgggttcaagcgattctcctgcctcagcctcccaaatggtatgcaattcctgttggttagcctcatctgaaaacgtcactcctggatacatagaacatcactgcgcatgtgcatctccccacccccgatgcctggtgtctaacgttcctccagtttctggtgctctgatgcattgcttttgggcttgtcttactacagcagctttcttcggtcctcagtcatttaccacttgtcatatgtcctttctagtttccagggatattcttttttatatttatggctttatgccatttatctcagttgtcatttggcgtttcaagaaggagaggtggtagtgtttaagtggaattaactacttgtgtttctgatgtggtcttttatatttcttacagggttttgttttaccaagtactagtct

SEQ ID NO: 156513 - DNA, 1136 bp, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENST ID: ENST00000377100
  CDS Start-End: 357-896
cgcggcagcgcgcacgcagggctagcctcgcccaggcctcctccctcacgccggccgcaggacgggcgcgcacgccaagtgacgctccgaggaggaagcgcagcccccttcccctccctcgctgcccctggcccagcgggagccccccctccccccagtgcgcctgtgcggaggccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgatggtatgcaattcctgttggttagcctcatctgaaaacgtcactcctggatacatagaacatcactgcgcatgtgcatctccccacccccgatgcctggtgtctaacgttcctccagtttctggtgctctgatgcattgcttttgggcttgtcttactacagcagctttcttcggtcctcagtcatttaccacttgtcatatgtcctttctagtttccagggatattcttttttatatttatggctttatgccatttatctcagttgtcatttggcgtttcaagaaggagaggtggtagtgtttaagtggaattaactacttgtgtttctgatgtggtcttttatatttcttacagggttttgttttaccaagtactagtcttcagtctatcctgtttacttgattttttcccactcaactcacaaacatttttgaatcatctcatgaattctgctttccatttacatttttgcccttttgtcttttcctcttcgctgttaaacttcctgaaaaaataaaactagttgattcacttctt

SEQ ID NO: 156514 - DNA, 184 bp, Homo sapiens
  Payload ID: 10684
  Gene Symbol: MLLT10
  Gene Name: myeloid/lymphoid or mixed-lineage leukemia
  translocated to, 10
  ENST ID: ENST00000430455
  CDS Start-End: 1-184
cgagaacccgctggtttattgcgacgggcacggctgcagcgtcgcggtgcatcaagcttgctatggcattgttcaagtacccactggaccgtggttttgcaggaaatgtgaatctcaggagagagcagccagagtggttgggcccatgtggtttgtgccctgtatattccagaggtacaatttg

SEQ ID NO: 156515 - DNA, 538 bp, Homo sapiens
  Payload ID: 10684
  Gene Symbol: MLLT10
  Gene Name: myeloid/lymphoid or mixed-lineage leukemia
  translocated to, 10
  ENST ID: ENST00000420525
  CDS Start-End: 1-538
cttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactagtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatc

SEQ ID NO: 156516 - DNA, 1085 bp, Homo sapiens
  Payload ID: 10684
  Gene Symbol: MLLT10
  Gene Name: myeloid/lymphoid or mixed-lineage leukemia
  translocated to, 10
  ENST ID: ENST00000438473
  CDS Start-End: 1-1085
gttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacgacagaggtgacagttctacactaacaaagcaagaacttaaattcataggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaa

SEQ ID NO: 156517 - DNA, 381 bp, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENST ID: ENST00000621220
  CDS Start-End: 1-381
atggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtggcagagtctcgctctgttgcccaggctaaagtgcagtggtgtgatctcagcccactgcaacctctgctccccgggttcaagcgattctcctgcctcagcctcccaaatggtatgcaattcctgttggttagcctcatctga

SEQ ID NO: 156518 - DNA, 4955 bp, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENST ID: ENST00000631589
  CDS Start-End: 102-3308
tggaatacaaactctcccgacatccgtagttactttcaaggtggattgtgtattttaaggctgatgggaacgtctggtttgtggagcaaaaagaagagaagatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataa

SEQ ID NO: 156519 - DNA, 4075 bp, Homo sapiens
  Payload ID: 10685
  Gene Symbol: MLLT11
  Gene Name: myeloid/lymphoid or mixed-lineage leukemia
  translocated to, 11
  Uniprot ID: Q13015
  ENST ID: ENST00000368921
  CDS Start-End: 2803-3075
aacagccttgagatgagatcacacaaacactcaaatgtagcttctaggggaggggagaacccaggaggctgggctttctcttctcttctcaccactggaagggaggagtaaccagaaggagcggaagctaaaacacgctgtccagagaggggagctgtggtcagtgggacgtcagtgagtcagtcatagggtttgtcctgatggtggtggtggcaggtggtaagggttggggaaaaatgaagaattagaggaaacccccaacaccagcaggcaggctgtactgtgactggactctccctcaacatcccccactctgctcaaagctgagggacagaggtggatagtgctgggagggaagagaagagagggggaggagaaggagagagggaaaggggcagtggagagaacaaggccatttctgtttcttttccagggacctgaccagagctgggtggagggaaagcgtgtgtgtgggacttggcatgaaatgaccaatgatgacgagaagtgaccaggaaattccattccctaggacattagggtctctgaaacttgagggtggggtcagagtgtgaagaagacaggtcagggtgaatgtgatggtagcgcagggcagtgggggatgggaacaaagccagaaaaggaagtaagagccactggcggccactcttctttaaagcagccagaagagagtgggttgaggaaaaatgaagtcctgagctggtcagcccaggcggaagagccacccgaatccaaccccacagtgaatagggaaggggctgagaaaacaacaggagggatgaggattagacctcataaggccacgtcctgagagccaagtggtgctcagaactcgacctctctgagttccaaatggcaagagtgaaatatggaaccgggaaagccaccccccgcccccaccaagatcatactaggacttgagggtctcagagctgttgggaggtgagcagaagggatgggaaagaggtgccagggaggaaggatgtacaggctagttctctggtcctgttcgggccccaaaccggttctcccggtcccaccgcctctggccctaaggcctccaacccgcggcctgacaagccctcacatgaagcagctggagagaaagaaagaatcgagagaatggcatgggcaattctggctagaagcccggggcagcagctggtccctgtgtggagaccccgagacatggagggctgctgagggactctggagaagcggtgtggactccatatttcagccaagtgacaggcccaacaccaaccttcccttccccaggaaaggtcttctgggggcttaagaggaaagagggctaggccctaagcctcccctccccaaatatattcaatcacacagattccgtatctgtctccccccactacacaactctacctagaagttctctgctgttctcaacccttaaccggactgggacctctctgggaatctttcggaccctctccctcccacctcccccaacattccagttccttcttttccttctactcttcagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagcccggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccagga

SEQ ID NO: 156520 - DNA, 708 bp, Homo sapiens
  Payload ID: 10686
  Gene Symbol: MLLT3
  Gene Name: myeloid/lymphoid or mixed-lineage leukemia
  translocated to, 3
  ENST ID: ENST00000380321
  CDS Start-End: 183-671
tcttaacagctctccattccttgctgacacacatgaacttaggggcacttctgttttcctgagggctacaccgttttcttttgaaagagtctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgtt

SEQ ID NO: 156521 - DNA, 6772 bp, Homo sapiens
  Payload ID: 10686
  Gene Symbol: MLLT3
  Gene Name: myeloid/lymphoid or mixed-lineage leukemia
  translocated to, 3
  Uniprot ID: P42568
  ENST ID: ENST00000380338
  CDS Start-End: 288-1994
gaggctcggagcccgggtgtcaggcgccacggcgcatgctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaagtgtacctgtaaatgtcctgaatccagcattgttgagctgtcatcaacattcttgtgtctgttttactgttacaatattaggtgaatatggaagtaaaggcattccacaggatcatcatttaaaaaaaaagaattctggtcctgttttctaaaaaaaaaaactgttgtagaaattcttaatttggatctatttattagtcagagtttcagctttcttcagctgccagtgtgttactcatctttatcctaaaaatctggaatcagagatttttgtttgttcacatatgattctcttagacacttttatatttgaaaaaattaaaatctttctttggggaaaaattcttggttattctgccataacagattatgtattaacttgtagattcagtggttcaatacctgtttagttgcttgctaatatttccagaaggatttcttgtattggtgaaagacggttggggatggggggatttttttgttcttgttgtacccttgttttgaaactagaaatctgtcctgtggcatgcaaaagaaagcaaattatttttaaaagaaaaaaaccaaagtacttttggtgtcattattccatcttctccataagtggagaaatgaaaagtaagaacagctcatcttcaaagtttttactagaaattcagccgaaaagaagagaaatgaagaaatacttctggatccaaaggttcgtcactggatcagccttaagaaagtctctatgtgtgctaatagaccagtatctcccttgtttgttcccatgccagatgctgtcttttcatacagagattaactagtgtctgtacagaaaatggtctttccagacccattcttttgggcagttatataaatgcagattgataatggagttatttctgcattttaaaaaggggattttttacactgtttctttctatccaaagaaactatttttcctttaaaaaattataatacagccatgctccttgtaaattatttctctgaagcgtcctcccagaggacaagtgtactttctcaataatgttatgattcttaatgacgattggcatgaaccgtacttgaagcatttgttgtattgtccacttcttgatgtgcagagaaactttgagtcattttggacattaggtgattgatgaattgtgtggtttcagttgcgttttgtttttaactttatagctggaaggggagggtaatgtttatatggaaatgttgcaaatttttaaaatattttaaaatttctaactgctaacacatattctgatcaagccagaagtttatgtgatttaatatatctgtgtagtttaactagaaacgtatatatgtagtttgggccatttttatttctgtaactaaattgtggggcaaaaaatatgatttgccaatgtaaaaattttttcctttaagttactaaccaagaagctaggtaagataagaaatgaccaaacaaaaataatgataagaaggacagctattatatgataaactttagacttgaaaattaggtaataaagttaatttcttcagaatatcctaaaatgtaagtttgtaaattgataaagttcagaaaaacttatccatcttctactcatcaagatagcaaagtaagtttttcacaaaattaagactgagagttacgttattttttttgaagtggtaatcttgctctcatctaatttttaaatacagaaataaaaagatccctttgaattaatttcaagtagttttaatacctctcttaaagtaaccccttcagttctgtcacatttatatacacccaactttgaagcctattaagaatatctttgacatgtgagtaccctaacagtggctctggtttcttaagcacaaagggaaaatggcagggtttaatttctttggtgtacatatataaatagatgtttcaaataaaattaattgggtaaatgtgaatatggtttgaaccagccagagtatgataaacttttaaaaaatttttcctcagtgatcagccaggggaaaaaatatatgtacagagctcctgcccctctgcccccttataacttagcttttgcctctggttttgcagcaggatgtgtgttggtgggtttggggttccttctgtcttcggatgtaacagtcatgttagcaacaatattttgcagttacttcaccatcctcagcataatctgcctctctctcaatcttaatacagacaaataggtatgtctataaatgcgttcatatagtgtcaaggtagggaagactataaaaacttcagatcaggaaaaaaatatctcttaagagagtgtcttaaacattttaaattgctaggcaatttaaatctctctaatctgaatattcaccttttggtggaaagagccagtaatattggttttcttccactaaaaagtttcttcaaaatttttttttttttttttttttttttttttttgccgatatcttttacaggcccacctaatctttaaaaaaaagagaagaaacaattttaggcctgtataacatcctatttactacttcaagctccacaaatgtagttaatatatttgtttaagagagactttactcttaaatgttttaactttgcctacttaatggagttggatgtccagtgttggaaacagtcagtgtctgtttggtggctcgtgtttatttttgtcactgtagaagtgatctgctctggagtaatttgctgtatgcttattactttccacctttagcgttttgtgtactaatgctatgtactgctcctatatttatatatacatatatatatatatatacacatatatattatcagagtaatcttgctttggactgttgctctaaaactatgaatatgatgtagagactactacagctgcagtgaatgttaaggagtcaattcccatggtttagtttagtctcgggctggaagtctacatcttttgacctcttttgttttatatgatgctttttattatgtaggcactgccatccctgaatattccttgtaaagatgcagtgaagaagtcaatttaaaaggaagacaaagccaccgctgtctgtaaactgtaaatgtgtattttggcacttgtactccagtattctgaaaatagagttatgatggaaatgctgacagatccttaatggtggccagagctaccatgcagtgcaaaaataaattaagtgaaaatgtattattgagattaacagtgcaaggccaatacattttataaatctgtcagtatctttttaatggactgtgtatgtgtagttatgttgaaagatacattgtgtatgtgtacatgcttttgtgtgaattcaaggcacactgtaagatgtatttcccttctctaaaatccatgttgaaatgtaagtacagattgatagaaataggtgttttacttaaactcatataatctgtttcagcaccttttttaaaatgtataattgtactgatttgctgagagtcatttgaccaaagtttggctttattttgcatacaggaaaaattagcccctagccttttctcaagaagtgatgctgtttctaaagaagaatagatggggagatctgagacatccagagagaggacaatgtgtccaaaaccagctgaaggcagagagtccatgcctcattcattttaggagtccctcatgtctaacaccatcttctgtgtcctaaagccagtatatatataatatttttaaaactctgcaaagattggaacaagaagtggtgggatacattttttggcataaactgggctatgtgtgcccggtattttttctttcccccctatttctttggagggttttgttcagaaacaatgtgctatagccagagagagtcgatcttacaaagtccctgcatttactttcacagcaagaactgctaccttgattagacaggaaggagaacaactactacaacaaagagaataaaatacattcagtttggtaaataaccaa

SEQ ID NO: 156522 - DNA, 2040 bp, Homo sapiens
  Payload ID: 10686
  Gene Symbol: MLLT3
  Gene Name: myeloid/lymphoid or mixed-lineage leukemia
  translocated to, 3
  Uniprot ID: P42568
  ENST ID: ENST00000630269
  CDS Start-End: 99-1796
atatttcagccgccgccgccgggagctgcgggcacagtccggggacgcggcgagcagcctcggcggccgcacctccgcaaagcgccgcggccgctacgatgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaa

SEQ ID NO: 156523 - DNA, 3264 bp, Homo sapiens
  Payload ID: 10686
  Gene Symbol: MLLT3
  Gene Name: myeloid/lymphoid or mixed-lineage leukemia
  translocated to, 3
  ENST ID: ENST00000629733
  CDS Start-End: 1481-1897
gccacggcgcatgctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaagtgtacctgtaaatgtcctgaatccagcattgttgagctgtcatcaacattcttgtgtctgttttactgttacaatattaggtgaatatggaagtaaaggcattccacaggatcatcatttaaaaaaaaagaattctggtcctgttttctaaaaaaaaaaactgttgtagaaattcttaatttggatctatttattagtcagagtttcagctttcttcagctgccagtgtgttactcatctttatcctaaaaatctggaatcagagatttttgtttgttcacatatgattctcttagacacttttatatttgaaaaaattaaaatctttctttggggaaaaattcttggttattctgccataacagattatgtattaacttgtagattcagtggttcaatacctgtttagttgcttgctaatatttccagaaggatttcttgtattggtgaaagacggttggggatggggggatttttttgttcttgttgtacccttgttttgaaactagaaatctgtcctgtggcatgcaaaagaaagcaaattattttt

SEQ ID NO: 156524 - DNA, 5823 bp, Homo sapiens
  Payload ID: 10687
  Gene Symbol: MLLT4
  Gene Name: myeloid/lymphoid or mixed-lineage leukemia
  translocated to, 4
  ENST ID: ENST00000351017
  CDS Start-End: 173-5668
ccaggcggaggccaagtcggaggacgcggcgcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccaggaagtagaccaggttgaccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaa

SEQ ID NO: 156525 - DNA, 5249 bp, Homo sapiens
  Payload ID: 10687
  Gene Symbol: MLLT4
  Gene Name: myeloid/lymphoid or mixed-lineage leukemia
  translocated to, 4
  ENST ID: ENST00000344191
  CDS Start-End: 173-5170
ccaggcggaggccaagtcggaggacgcggcgcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggcagactgctatgccagcaatctctgttctagatttgttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaaggttatggtcctttaagggcagctagaattttaccaagttagcctgaacgtaatcgattggctggggcagagcgggctggaagttctgtgtttct

SEQ ID NO: 156526 - DNA, 5962 bp, Homo sapiens
  Payload ID: 10687
  Gene Symbol: MLLT4
  Gene Name: myeloid/lymphoid or mixed-lineage leukemia
  translocated to, 4
  ENST ID: ENST00000366806
  CDS Start-End: 320-5665
gtggctcgcggcgccccttcgccgtggccgggatggagcctgtgacgcgcgctgtgcttcgggttcataaacttgcaggctgccagctgggaggggaaagtcagtatcacaaagttcgggaggtgcgggctgcctgatggcacaggcccggagtcggacgcctccgaggaaaggcgcgccttctccaccttcggggccgcgaggaagggccctctgcggcggcctctgcccggagggaggcgccggccccaggctggctccctgagaggaggaggaaatcacgctcgctcctggcctggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgagggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacag

SEQ ID NO: 156527 - DNA, 6812 bp, Homo sapiens
  Payload ID: 10687
  Gene Symbol: MLLT4
  Gene Name: myeloid/lymphoid or mixed-lineage leukemia
  translocated to, 4
  Uniprot ID: P55196
  ENST ID: ENST00000392108
  CDS Start-End: 143-5098
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgagggacgaggagcggaggcggcagcagcagttagaagagatgcgcaagcgggaagcggaagaccgagcgaggcaagaggaagagcgccggcggcaggaggaggagcgaacaaaacgagacgctgaagaaaaggttatggtcctttaagggcagctagaattttaccaagttagcctgaacgtaatcgattggctggggcagagcgggctggaagttctgtgtttcttaagaagcacgaggcagagcagggcctggctcccccagctttgtgattggacctgcaactttaccccatctggcccacctacctctcttctggactgtctccagatccccttatctgccaagttttgtctccttcaaacttctgaactcttgggcgtgtgtagcagtgagcctctttgcaaagggttcgtttcctcgggcactcatctttactgaacatggcccagcttgtcattgtgaaggtgacattggttcagtgattgcttaaatggcatgtggaccgtgggaagcagtaggagcgtagtaagacagttggctgccattcaacatttcaaatagatggtttactcaaatcactcacttctggttgatggtaaagagagcagatggcttagaaaacatgatacaggaaaatttagtatgtaatccagtaaatatcctaagttatttattttcatgtgtgtgtgtgtgtttaaatcaagtaacccttttaattgaattttaaaatgacagcgaattttgacattctgagaaatggggattttgagatgtttctctccatatctccctttgtcctgtgtgtgtggccgacgccctctggatgaagaggctgtagccgttgagctccctgtgggggcctgtttcatcccgaggggactgcgtgttgctctgtgtggtttgagagaagctgctcttctctgttacttcccttctatgaaggtagaagctttcagtgttacaacttctgatggcggaaaatttagtttttattaataattccttcttggatagtctagtgaactatattaatagaacagtgtactgttcacagaaaagaacttgtagggagttttttgtagtgatatgctctattaggatacagaacaatctaagagtaagcttgatagacatgatgtgacttcacttaaatggagtagagtgaataatgtaaggacactcacctctgttgaaattggtgatttctgcattttgtagacctttgccctctaagtttatcatcatattatctgttgaatctgaacagcatttgaagtcctctcaaagagtttgagctttcaggattaggttcccctgtgagtctttcacttgtgtaatggtaagtcaacattgatgatctttctaaggaaatcagatttacaaaatgctgagccgcttgatgtctaagtgttggtggtttttgctgttgctttgctgttccatgaaagcgctccctggctgcttggagggctgtgcttttccaggtcagtgccagcttggctgtcccaggccgtgcacagtgcccattgctatagctgggcccagtcctggccacgccggagcctcggcgggggcagctgggttgtcacggcagcacagtgcacatgcagagaggaccaggccatgtttttcctgtgctgagaaactcttgggttatttaatttttccaatgtgttttcataactcatgattatttgaaatacacttgtgttagtaactgcttctataattaagtggtcactgtaaaaaggcgaataacctatttttatatcagaatgtccaaaactcatgggtttgctttgttatagaaaaatgtgccattcatttgttgggtagaataaagttgtcttgtaattgt

SEQ ID NO: 156528 - DNA, 7459 bp, Homo sapiens
  Payload ID: 10687
  Gene Symbol: MLLT4
  Gene Name: myeloid/lymphoid or mixed-lineage leukemia
  translocated to, 4
  Uniprot ID: P55196
  ENST ID: ENST00000392112
  CDS Start-End: 143-5374
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagta

SEQ ID NO: 156529 - DNA, 7593 bp, Homo sapiens
  Payload ID: 10687
  Gene Symbol: MLLT4
  Gene Name: myeloid/lymphoid or mixed-lineage leukemia
  translocated to, 4
  Uniprot ID: P55196
  ENST ID: ENST00000400822
  CDS Start-End: 1-5505
atgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggactgctatgccagcaatctctgttctagatttgttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgccttcgaaatcacttttaataaaagttgtatgataaatcattaaaaatgcgagtgtaaatatttttttttacctctatcagggtttttatttgaaagtgtgctcttaccatttccttgtttgagtaagagagtgaatggttctgagtgtttaggaaggatttgcttgcttgcagcagaagttctaggaaaagcaggcacctcccaaatatcttgaggacactggcagccttatggtgactaaatccacactttctttaaagagatgcagatgaattacttttctgttaatatatagaaaaatacacaggagaacatgcagatacatgtaaatatctacatacagggatatttgtatgtgtggttgtgaaacccatacacaagtggatttggccatctttgggcagtgaggtcaaatgtgaatatgtgtaaaagtgcttttcagaactgcattactatgagaaaacatcaaaactgctgtagttttccatttctactgtatttcagttgcaacctatttttaataaactttgtatgtatttaagtgtatttgctattgttttgaaagtgctgacaaagtttatatttgtaacatcagccttcctcgcccatctctttccatctgtctcttcttcattaaacacttactgagtatga

SEQ ID NO: 156530 - DNA, 875 bp, Homo sapiens
  Payload ID: 10687
  Gene Symbol: MLLT4
  Gene Name: myeloid/lymphoid or mixed-lineage leukemia
  translocated to, 4
  ENST ID: ENST00000400824
  CDS Start-End: 134-875
gaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcag

SEQ ID NO: 156531 - DNA, 963 bp, Homo sapiens
  Payload ID: 10687
  Gene Symbol: MLLT4
  Gene Name: myeloid/lymphoid or mixed-lineage leukemia
  translocated to, 4
  ENST ID: ENST00000400825
  CDS Start-End: 212-963
ggcggggctgaggcggcgcggcgcggcgcggactgagccccaggcggaggccaagtcggaggacgcggcgcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgag

SEQ ID NO: 156532 - DNA, 5475 bp, Homo sapiens
  Payload ID: 10687
  Gene Symbol: MLLT4
  Gene Name: myeloid/lymphoid or mixed-lineage leukemia
  translocated to, 4
  Uniprot ID: P55196
  ENST ID: ENST00000447894
  CDS Start-End: 1-5475
atgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagggagaaggaatcactttgcctactacaactatcacacttacgaagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtga

SEQ ID NO: 156533 - DNA, 1807 bp, Homo sapiens
  Payload ID: 10687
  Gene Symbol: MLLT4
  Gene Name: myeloid/lymphoid or mixed-lineage leukemia
  translocated to, 4
  ENST ID: ENST00000423229
  CDS Start-End: 1-1168
ggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccaggtacgttccagccggccagccatgctcctccagtgattgtggttgtaattgctaagccagtgaattcagcttctttaaggcttctcatttggttacaagatttttttctaaaataaaagttatgtaaatattgtaggaaaatgtataactttaaagagttgaaaggaaatgcaagcttttttctattttgttttccctgtaaaacttcagcataagtgaagttaacttgtagtaatagttgtgagaaagtgctgagactgttgtgggcttttgtagaattttttctgtaaataatttgttgagatgaagttcatataatattaaccattttgaagtgaacaattcagtcgcatttggtgcattcacagtgttgtgcagccaccacccctgtcggttccaaaacgtctccatcacctcagagcgatacccctcaagtagttcctggggtttttctcttcccccgttccctggtaacgccttcttagactttttaaaaatggttctcaaaagtcacttgctcctgtgtaatgagcctagacgttggtagtaattgggctttttgatagcacatgtgtaggtgtaatggacattgtaacatacttctcacttaaaatgaaattctgtcataaacctgttttcaaaatttcagaagataaaggtattttgttggtagaa

SEQ ID NO: 156534 - DNA, 1031 bp, Homo sapiens
  Payload ID: 10687
  Gene Symbol: MLLT4
  Gene Name: myeloid/lymphoid or mixed-lineage leukemia
  translocated to, 4
  ENST ID: ENST00000507704
  CDS Start-End: 1-941
gtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgagggacgaggagcggaggcggcagcagcagttagaagagatgcgcaagcgggaagcggaagaccgagcgaggcaagaggaagagcgccggcggcaggaggaggagcgaacaaaacgagacgctgaagaaaagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaaggg

SEQ ID NO: 156535 - DNA, 746 bp, Homo sapiens
  Payload ID: 10687
  Gene Symbol: MLLT4
  Gene Name: myeloid/lymphoid or mixed-lineage leukemia
  translocated to, 4
  ENST ID: ENST00000515794
  CDS Start-End: 1-373
cgatggcgtctttctctccaactcattccagccaccctcagccaaagccaacagtactgctcacaaaaaaggccagcccctgccccctccaaaaaaatccagctcctaccatcccagccactgcaaaggtagaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccccaaaatcttttcagttgtgggtttgtaggtgcgagtttgaagaggaaaagaggaagggggttatatttctaagtgatttacaatttctgtttctaaaattgttgggatttagaaatgtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaaga

SEQ ID NO: 156536 - DNA, 606 bp, Homo sapiens
  Payload ID: 10687
  Gene Symbol: MLLT4
  Gene Name: myeloid/lymphoid or mixed-lineage leukemia
  translocated to, 4
  ENST ID: ENST00000485634
  CDS Start-End: 1-574
gcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggaccaaactcttacccaggatctactggagcagctgttggagcccatgacgcctgtcgggatgcaaaagagaagcgctctaaaagccaagatgcagattcacctggaagttctggggcccctgaaaacttgacattcaaggaacgccagcgtcttttttcacaaggtcaagatgtatccaataaagtgaaagcttctcgtaaattaacagaactggagaatgaactgaacacaaagtgaaagaaaatgaggagaacactttgtatttaccc

SEQ ID NO: 156537 - DNA, 867 bp, Homo sapiens
  Payload ID: 10687
  Gene Symbol: MLLT4
  Gene Name: myeloid/lymphoid or mixed-lineage leukemia
  translocated to, 4
  ENST ID: ENST00000476946
  CDS Start-End: 1-389
agaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgaggttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaaggttatggtcctttaagggcagctagaattttaccaagttagcctgaacgtaatcgattggctggggcagagcgggctggaagttctgtgtttcttaagaagcacgaggcagagcagggcctggctcccccagctttgtgattggacctgcaactttaccccatctggcccacctacctctcttctggactgtctccagatccccttatctgccaagttttgtctccttcaaacttctgaactcttgggcgtgtgtagcagtgagcctctttgcaaagggttcgtttcctcgggcactcatctttactgaacatggcccagcttgtcattgtgaaggtgacattggttcagtgattgcttaaatggcatgtggaccgtgggaagcagtaggagcgtagtaagacagttggctgccattcaacatttcaaatagatggtttactcaaatcactcacttctggttgatggtaaagagagcagatggcttagaaaac

SEQ ID NO: 156538 - DNA, 728 bp, Homo sapiens
  Payload ID: 10687
  Gene Symbol: MLLT4
  Gene Name: myeloid/lymphoid or mixed-lineage leukemia
  translocated to, 4
  ENST ID: ENST00000497596
  CDS Start-End: 1-504
gctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggcaagtattttgagggtaccatgaagtgaaatggatccttaggacttgaagatgtgatgcagatttgtttctttcttacactgaagattggtgtgatggcagagttttaaaatcgctgttaaatactgatattcagaaattttcaagccataattcatatatatgtattttttcctcccaagccatgtctattacagttttgtctgtaagcagtggtgctttttaaaataaagaacacttatacccat

SEQ ID NO: 156539 - DNA, 7578 bp, Homo sapiens
  Payload ID: 10688
  Gene Symbol: MLLT6
  Gene Name: myeloid/lymphoid or mixed-lineage leukemia
  translocated to, 6
  ENST ID: ENST00000618876
  CDS Start-End: 92-3373
gcgcgcggccccccgctccctccctcccccctgacccccgacccccgccggccggccccccgccccagccccggagggagctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgcaaaaaaaaaaaaaaaaatccgaaga

SEQ ID NO: 156540 - DNA, 2714 bp, Homo sapiens
  Payload ID: 10688
  Gene Symbol: MLLT6
  Gene Name: myeloid/lymphoid or mixed-lineage leukemia
  translocated to, 6
  ENST ID: ENST00000616632
  CDS Start-End: 92-1069
gcgcgcggccccccgctccctccctcccccctgacccccgacccccgccggccggccccccgccccagccccggagggagctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaagcctagaaggggccaccaatcaccgaccaaccatgggattgggagtttggggtgctgtctgccagatactcccatctgcctctgtccagagggcctcagccctgggctcttgtctgcagagagtgggggacggcactcaggcctgctctccaagttctagggcccctgtccccagagatcggtagaggacatcccctacgccccatcaggaggacacccaaagcttgtcacccaacccaaatcccactctgtgcaggttggaggggctgaaagttctgaccaaggtggcatggggggcaggcccctggacagtatcccgaaactcccactcatcccaccattcccagcagggcatggtatgtcaggcctgtctccagaaatgggcaacatctggctgagcgataggcaggccctaccctaggccagggaattgctaatccaagctggaacagccctccctgctccctacaacctgccctccccatgggaggagaacctggtagggtggggggagatggagaaactgctccctcctgtcaccattattgcccattcacctccaccccatctcagacggttggcagagttctgggcaccttagcaggaggttcaggtatcaggtttccagggtgatgttgctgtggcaactgccccagtaaacctctcccctgcttcccagggctcacctggagaccttgtcattcatgccctctgacctttccaggggcctgcaggcaggtggcaagaaatggccaggggtctgggagtttttccagtaactggatgtcccttggacatgccagagaactctgcccatcctcctccactcgccccagcacttcggctacccttccccccagcccctctcttcccttgctctcagaaccacatctggctcccttcagaactccagctgttgaaaagaacaaagaggaagacagagaccaggactccgcccgggaggggcagtgcagggtggctctcgtttctggtccagcctgcattcagcatttatctgttcagcacgattaactgaatacctggtcgctactaggaggaaaagggccttccctggcagcagcctgaagcacgaacgaactcacggcatgccaggctgtgttctagaaccaggagatggaggggcatatggagattagtccatttaatactcaaaataatccaattaggttggaaatttataaaccccatttaatatatgaagatgatggggcacagggaggttaagtaatttgcctaaaagcacacagctagtaaagtggtagacctgagattccaatgcagtctggcttgaaggcttgtgctcttcacctgcccacagcactgtctctgcagctgctgccactggacgtctcatcatttattgaccctataccatgtatctggcatcatgctgcttccaactcaccacatatgcatagtgctccctgtaaagacactgacacttatcgacgttgagactttgcacagtataacatggcagtgaggccaggcgtggtggctcacgcctgtagtcccagcactttgggagtccgaggcaggtggatcacctgaggtcaggggttcgagatcagcctggccaacatggtgaaaccctgcctctattaaaaatacacaaaattagccgggtgtggtggctggtgcctgtaatcccagctacttgggaggctgaggcaggagaatcacttgaacctgggaggtgattgaaggttgcagtgagccgagatcgcaccattgcactccagcctgtgcaacaagagtgaaactccatctcaaaaataaattaa

SEQ ID NO: 156541 - DNA, 1208 bp, Homo sapiens
  Payload ID: 10688
  Gene Symbol: MLLT6
  Gene Name: myeloid/lymphoid or mixed-lineage leukemia
  translocated to, 6
  ENST ID: ENST00000615858
  CDS Start-End: 1-907
gcctgcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggtgggcgctacgaggagtggggcaggaaggagggggagactcaaggctctcctggtcccatctcttccccgcagctattggaggctgggcaatgaagtgactgactgagcaattgattgatccattcagtcctcccttaatcaagtaatatttatgaggtgcccacttagtgccagccattggctaagcaatcagtgagcaaaaccggcacagcgctgcttcttaagataggctaccccaagcaaagaaggagtaatcacaaactgggagatatgttagtgtggagagaaattgagggctgtgagagagagaacgggggagggctgcttctgtggatagaaagtggttagggaaggcctctttgagaagtatttgtgaagggtttattatagcgcctcacacaaaataa

SEQ ID NO: 156542 - DNA, 7578 bp, Homo sapiens; identical to SEQ ID NO: 156539
  Payload ID: 10688
  Gene Symbol: MLLT6
  Gene Name: myeloid/lymphoid or mixed-lineage leukemia
  translocated to, 6
  ENST ID: ENST00000621332
  CDS Start-End: 92-3373

SEQ ID NO: 156543 - DNA, 2714 bp, Homo sapiens; identical to SEQ ID NO: 156540
  Payload ID: 10688
  Gene Symbol: MLLT6
  Gene Name: myeloid/lymphoid or mixed-lineage leukemia
  translocated to, 6
  ENST ID: ENST00000620609
  CDS Start-End: 92-1069

SEQ ID NO: 156544 - DNA, 1208 bp, Homo sapiens; identical to SEQ ID NO: 156541
  Payload ID: 10688
  Gene Symbol: MLLT6
  Gene Name: myeloid/lymphoid or mixed-lineage leukemia
  translocated to, 6
  ENST ID: ENST00000634099
  CDS Start-End: 1-907

SEQ ID NO: 156545 - DNA, 3047 bp, Homo sapiens
  Payload ID: 10689
  Gene Symbol: MYADM
  Gene Name: myeloid-associated differentiation marker
  Uniprot ID: Q96S97
  ENST ID: ENST00000336967
  CDS Start-End: 149-1117
accaggccccgcccagcggccgcagccagccaggccgcgcccgggacgactgcagagcgcggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggt

SEQ ID NO: 156546 - DNA, 1492 bp, Homo sapiens
  Payload ID: 10689
  Gene Symbol: MYADM
  Gene Name: myeloid-associated differentiation marker
  Uniprot ID: Q96S97
  ENST ID: ENST00000391768
  CDS Start-End: 403-1371
ccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccc

SEQ ID NO: 156547 - DNA, 3186 bp, Homo sapiens
  Payload ID: 10689
  Gene Symbol: MYADM
  Gene Name: myeloid-associated differentiation marker
  Uniprot ID: Q96S97
  ENST ID: ENST00000391769
  CDS Start-End: 281-1249
gccgactcgaagcccttataaggcgcggagacaccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggtaaaagaa

SEQ ID NO: 156548 - DNA, 3056 bp, Homo sapiens
  Payload ID: 10689
  Gene Symbol: MYADM
  Gene Name: myeloid-associated differentiation marker
  Uniprot ID: Q96S97
  ENST ID: ENST00000391770
  CDS Start-End: 149-1117
agacccttccagctgccgctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggtaaaagaagg

SEQ ID NO: 156549 - DNA, 3111 bp, Homo sapiens
  Payload ID: 10689
  Gene Symbol: MYADM
  Gene Name: myeloid-associated differentiation marker
  Uniprot ID: Q96S97
  ENST ID: ENST00000391771
  CDS Start-End: 213-1181
agacccttccagctgccgctgtcgtctttgcttcagccgcagtcgccactggctgcctgagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggt

SEQ ID NO: 156550 - DNA, 1009 bp, Homo sapiens
  Payload ID: 10689
  Gene Symbol: MYADM
  Gene Name: myeloid-associated differentiation marker
  ENST ID: ENST00000421337
  CDS Start-End: 283-1009
ccactcctggactcggcctccacccctgggcttggcctcaaagcctcctcagttgtcggccctggaaggtgcccagcggcggcagcgccagacgcgccccgttagctcagcgtcgctgagcatccgcagccgccaccaggccccgcccagcggccgcagccagccaggccgcgcccgggacgactgcagagcgcggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggc

SEQ ID NO: 156551 - DNA, 777 bp, Homo sapiens
  Payload ID: 10689
  Gene Symbol: MYADM
  Gene Name: myeloid-associated differentiation marker
  ENST ID: ENST00000448420
  CDS Start-End: 213-777
agacccttccagctgccgctgtcgtctttgcttcagccgcagtcgccactggctgcctgagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcg

SEQ ID NO: 156552 - DNA, 592 bp, Homo sapiens
  Payload ID: 10689
  Gene Symbol: MYADM
  Gene Name: myeloid-associated differentiation marker
  ENST ID: ENST00000414489
  CDS Start-End: 153-592
gcctgttccaagtgtggcttaatccgtctccaccaccagatctttctccgtggattcctctgctaagaccgctggttgcccaggctggtctccaactcctgggctcaagcaatcctcctgcctcagcctcttggagtgctgggattacagccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgc

SEQ ID NO: 156553 - DNA, 841 bp, Homo sapiens
  Payload ID: 10689
  Gene Symbol: MYADM
  Gene Name: myeloid-associated differentiation marker
  ENST ID: ENST00000439000
  CDS Start-End: 64-841
agacccttccagctgccgctgtcgtctttgcttcagccgcagtcgccactggctgcctgagccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccc

SEQ ID NO: 156554 - DNA, 2282 bp, Homo sapiens
  Payload ID: 10690
  Gene Symbol: MYADML2
  Gene Name: myeloid-associated differentiation marker-like 2
  Uniprot ID: A6NDP7
  ENST ID: ENST00000330655
  CDS Start-End: 187-1110
cagcagaaccctgtgaaccccaggcaatgacagcaggatcctgaagcccatgcaggctctgaaccacgcggccatccagaaggggctgcaggcacctgccactaccgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgggcacagcccgcgtgctgcagctggcctttggctgcactaccttcagcctggtggcccaccggggtggctttgcgggcgtccagggcaccttctgcatggccgcctggggcttctgcttcgccgtctctgcgctggtggtggcctgtgagttcacacggctccacggctgcctgcggctctcctggggcaacttcaccgccgccttcgccatgctggccaccctgctatgcgcgacggctgcggtcctgtatccgctgtactttgcccggcgggagtgttcccccgagcccgccggctgtgctgccagggacttccgcctggcagccagtgtcttcgccgggctcctcttcctggcctacgctgtggaggtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagaggattcgcttcgtgcccagcctgtagcccacagtggcagcccacccacctctgctctctggccaccagctccaggctctgcgagggaaactcaggtgaaccaaagtgtcaagtagcgagcaggagggaagccgcgggctcaggggagatgaagtacaacgggagaggtcactccccgacttccagactgggctcagagggacaagggcaggacagtagggcagaggccctgagcagacgcaggggagagcctcacctaggccaatccccaactcactctctctcaccatttcccagcgctcctggggctcagtgctggtcactggaacatcataagggaaaactttaaagcagctgctgttgtgacccattttgcagctggggacatggaggctagaagcatttgcgaggcacccagtacctccattagtgtctggagaccacagtcaggctgggtaaggcaagctgaaagaggaatgacttccagaggagacgaacccaggagagtagctgggccaggcaaggggagggaggggcgtggggagccggaaccactcctggttcagagaggcagctcccagaaccctgggaagagagccctgcctggggagctgtgccagctcacagagaaggagccagaaatctggaccagcctctcccacccacgtccgggaagcctctgggctggtagccacagtgtttggaagcaggcttcctccggagtctccgcaggctggaggtggcgcgggtggcctggaagagcctgcagagcccggcggcaccgagtgcacagtggacggggaggacctggttccgccatagccacggagccccacctggacactcaccattggctgtgacgaagcagcttcagcagtgcccggcgggcatctgtgcactgtgggcatctgtggcactgggagggagcccggctgagggcggccgctggacacagaatctgggtactgcttgcctctgctcaagggtccagttgccgaaactcctgacgccggggccatcatcctccaggctccagccagcttctcctgcacagaagcccagcctggtccagccaggagctgacccactggccacccctgagtccaagccgggtgggcagtggcacaacagcccctcagcccattgactgggccccattgacgtccttgagcaggaaataaatgctgacatttatacgt

SEQ ID NO: 156555 - DNA, 2452 bp, Homo sapiens
  Payload ID: 10690
  Gene Symbol: MYADML2
  Gene Name: myeloid-associated differentiation marker-like 2
  Uniprot ID: A6NDP7
  ENST ID: ENST00000409745
  CDS Start-End: 356-1279
cttcagatgccagtcccaagtacagctgtccctttgtatccttgggggatgggatccagtacctccaaaacaccagaatccacaaggccagagtccctgatacaaaatggcatgttatttgcatataaccccctcctctggacttaaatcacctcttgattacttataacacctgaaccctgtgaaccccaggcaatgacagcaggatcctgaagcccatgcaggctctgaaccacgcggccatccagaaggggctgcaggcacctgccactaccgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgggcacagcccgcgtgctgcagctggcctttggctgcactaccttcagcctggtggcccaccggggtggctttgcgggcgtccagggcaccttctgcatggccgcctggggcttctgcttcgccgtctctgcgctggtggtggcctgtgagttcacacggctccacggctgcctgcggctctcctggggcaacttcaccgccgccttcgccatgctggccaccctgctatgcgcgacggctgcggtcctgtatccgctgtactttgcccggcgggagtgttcccccgagcccgccggctgtgctgccagggacttccgcctggcagccagtgtcttcgccgggctcctcttcctggcctacgctgtggaggtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagaggattcgcttcgtgcccagcctgtagcccacagtggcagcccacccacctctgctctctggccaccagctccaggctctgcgagggaaactcaggtgaaccaaagtgtcaagtagcgagcaggagggaagccgcgggctcaggggagatgaagtacaacgggagaggtcactccccgacttccagactgggctcagagggacaagggcaggacagtagggcagaggccctgagcagacgcaggggagagcctcacctaggccaatccccaactcactctctctcaccatttcccagcgctcctggggctcagtgctggtcactggaacatcataagggaaaactttaaagcagctgctgttgtgacccattttgcagctggggacatggaggctagaagcatttgcgaggcacccagtacctccattagtgtctggagaccacagtcaggctgggtaaggcaagctgaaagaggaatgacttccagaggagacgaacccaggagagtagctgggccaggcaaggggagggaggggcgtggggagccggaaccactcctggttcagagaggcagctcccagaaccctgggaagagagccctgcctggggagctgtgccagctcacagagaaggagccagaaatctggaccagcctctcccacccacgtccgggaagcctctgggctggtagccacagtgtttggaagcaggcttcctccggagtctccgcaggctggaggtggcgcgggtggcctggaagagcctgcagagcccggcggcaccgagtgcacagtggacggggaggacctggttccgccatagccacggagccccacctggacactcaccattggctgtgacgaagcagcttcagcagtgcccggcgggcatctgtgcactgtgggcatctgtggcactgggagggagcccggctgagggcggccgctggacacagaatctgggtactgcttgcctctgctcaagggtccagttgccgaaactcctgacgccggggccatcatcctccaggctccagccagcttctcctgcacagaagcccagcctggtccagccaggagctgacccactggccacccctgagtccaagccgggtgggcagtggcacaacagcccctcagcccattgactgggccccattgacgtccttgagcaggaaataaatgctgacatttatacgta

SEQ ID NO: 156556 - DNA, 1018 bp, Homo sapiens
  Payload ID: 10691
  Gene Symbol: MYDGF
  Gene Name: myeloid-derived growth factor
  Uniprot ID: Q969H8
  ENST ID: ENST00000262947
  CDS Start-End: 37-558
gtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaa

SEQ ID NO: 156557 - DNA, 463 bp, Homo sapiens
  Payload ID: 10691
  Gene Symbol: MYDGF
  Gene Name: myeloid-derived growth factor
  ENST ID: ENST00000599761
  CDS Start-End: 1-254
accaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagttatctcagccccacaagaaaaaggagatgaccagccccattggacagatggggaaactgaggcctagaagctggggatttacaagatcccaagaactctgccagaggtccctgcgtcaaagctcgagcgggtgtgattccagggaggtcatctgctgaggggtgtcgggagatgctgggaaggggcaggcatgctgtggaactgggccgttcctgcctctcgctctgcctccttgccctgctccccgtctgtaacacctgagctgtacctgggcaa

SEQ ID NO: 156558 - DNA, 713 bp, Homo sapiens
  Payload ID: 10691
  Gene Symbol: MYDGF
  Gene Name: myeloid-derived growth factor
  ENST ID: ENST00000599630
  CDS Start-End: 29-598
gcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcaggtacggaaagatggggatggggtagaggtgacgccacccccatccaagggtgggcaatcggggcagtttggagaggggggtcagccataggggtcctggagactgtagaccaggcatccacaaactgattctataaaggccacctcgtcaatatcttcagctttgtggcactgtgggttctgtctagagctgtgccattgtggcacaaagctgctgcagacagtatgtccatgcgtgggtgtg

SEQ ID NO: 156559 - DNA, 2287 bp, Homo sapiens
  Payload ID: 10692
  Gene Symbol: MYEOV
  Gene Name: myeloma overexpressed
  Uniprot ID: Q96EZ4
  ENST ID: ENST00000308946
  CDS Start-End: 451-1392
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacacttctgctcgttgcctttgggctcagtgaagagtctggagtttatctggagtgaggtggccggttcttggtgggatctgagcaggacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccagtctgtcccccttggggacagggactcgttgctcatgttcacccggcaggctggacacttcgtggagggctccaaagccggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggtggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctca

SEQ ID NO: 156560 - DNA, 1996 bp, Homo sapiens
  Payload ID: 10692
  Gene Symbol: MYEOV
  Gene Name: myeloma overexpressed
  Uniprot ID: Q96EZ4
  ENST ID: ENST00000441339
  CDS Start-End: 562-1503
cttgccttgattctcctgttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacacttctgctcgttgcctttgggctcagtgaagagtctggagtttatctggagtgaggtggccggttcttggtgggatctgagcagagtccattcaggagcaggaaagttcatctcagaccctaaatccagccacgtcatgccacgcttaacacctctaacaacttcccctggcacttaggacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccagtctgtcccccttggggacagggactcgttgctcatgttcacccggcaggctggacacttcgtggagggctccaaagccggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggtggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtc

SEQ ID NO: 156561 - DNA, 2306 bp, Homo sapiens
  Payload ID: 10692
  Gene Symbol: MYEOV
  Gene Name: myeloma overexpressed
  ENST ID: ENST00000535407
  CDS Start-End: 644-1411
actgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacacttctgctcgttgcctttgggctcagtgaagagtctggagtttatctggagtgaggtggccggttcttggtgggatctgagcaggtctctgcactcgctgttgcctctgcctggaacagtctccctcctggtgtcattgtctccgtggtgtgtccttcctgaccttccacctccaccaggtgccgacacttccctgaccccagtaacctcttctcttgggtgggtgaatgccacctgctgatgtctgatttattcatcggttttcttgtctgtagtctgtcccccttggggacagggactcgttgctcatgttcacccggcaggctggacacttcgtggagggctccaaagccggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggtggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctca

SEQ ID NO: 156562 - DNA, 759 bp, Homo sapiens
  Payload ID: 10693
  Gene Symbol: MYEOV2
  Gene Name: myeloma overexpressed 2
  Uniprot ID: Q8WXC6
  ENST ID: ENST00000307266
  CDS Start-End: 1-759
atgtggcgcgcgccggaagcggctctgaggccggaagtgagcctagagcgccgcggccccgagatgaagccggcggtggacgagatgttccccgagggcgccgggccctacgtggacctggacgaggtggcacgggcccggcgggagtctccgagcgcgggaggcagcaccgggctcttgatggacttggcagccaatgaaaaggccgttcatgcagacttttttaacgattttgaagatctttttgatgatgatgacatccacagctcaggactgcccaggacaagccagcagtcctccatggttcccgcactgcagcgagggcagtcggagcacggggtccgtgggaaggcagcagagcggcctgtggtgtcggaagagagatgtgaactgaacgggagagaagtggcagctttggacagagcgtttgggagcacaggccatgggcagggggcggaggcgctaatgtttaccagatgcagagaacatccgctgtgtggcaccaacaaagcaacaagtgaggggaaaatgggcacaggacgcttaagaaacagtttacggaagaaccaatccaagtggctgggaagttatctagaggtgctcagaaccacaagaagcaggcgagaggtcagcgaagacagcacaatatcagtttctactcactggaggggtaaatgttttaagagtgatgaaacaccatccgttgctggtggagaagaagggaagaagaccacacagccatgcatagatgtgaggtag

SEQ ID NO: 156563 - DNA, 609 bp, Homo sapiens
  Payload ID: 10693
  Gene Symbol: MYEOV2
  Gene Name: myeloma overexpressed 2
  ENST ID: ENST00000403160
  CDS Start-End: 461-609
ctccccgccgcggtgcgaggggccccgtgtgccgcgcacccttccacccgtgttttgctgtttttttgactctgggcgtcccaggggtgcagcggccgtggggccctggtttgctttcacctcttcatctgctcactggccgcgagtgtgtcttcttcagacaaacgtctgaaggtcaagccctgggctcctgtgaacccggccgtctttgcggcagagtctgaggctccttctttattctggatccggcctctggtcggaggcgtgctctgcaggcactgctcccattgctggcagccttttctccccgtggccgcccggccgcccatcagaggcgttgcagacgcccgccctcgccagcgcaaagacaaacgccggtggccgcggacgcgccggcggccgggagcaccccagcgggcgggcaccacagaggcgcggtcctccggcgtctagatctgccatgtggcgcgcgccggaagcggctctgaggccggaagtgagcctagagcgccgcggccccgagatgaagccggcggtggacgagatgttccccgagggcgccgggccctacgtggacctggacgaggcgggaggcagcaccgggctctt

SEQ ID NO: 156564 - DNA, 418 bp, Homo sapiens
  Payload ID: 10693
  Gene Symbol: MYEOV2
  Gene Name: myeloma overexpressed 2
  Uniprot ID: Q8WXC6
  ENST ID: ENST00000607357
  CDS Start-End: 20-193
agagcgccgcggccccgagatgaagccggcggtggacgagatgttccccgagggcgccgggccctacgtggacctggacgaggcgggaggcagcaccgggctcttgatggacttggcagccaatgaaaaggccgttcatgcagacttttttaacgattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtcaca

SEQ ID NO: 156565 - DNA, 3215 bp, Homo sapiens
  Payload ID: 10694
  Gene Symbol: MPO
  Gene Name: myeloperoxidase
  Uniprot ID: P05164
  ENST ID: ENST00000225275
  CDS Start-End: 178-2415
gacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 156566 - DNA, 260 bp, Homo sapiens
  Payload ID: 10694
  Gene Symbol: MPO
  Gene Name: myeloperoxidase
  ENST ID: ENST00000577220
  CDS Start-End: 1-260
cggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcagatctcattgccccggatcatctgcgacaacacaggcatcaccaccgtgtctaagaacaacatcttcatgtccaactc

SEQ ID NO: 156567 - DNA, 6779 bp, Homo sapiens
  Payload ID: 10695
  Gene Symbol:
  Gene Name: MYO16
  ENST ID: ENST00000635050
  CDS Start-End: 42-5618
caggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaagctctggcccggcccagaccgcacagcgacgactacagcaccatgaagaagattcctcctcgaaagcccaagcgcagccccaacaccaagctcagcggctcctacgaggagatatcggggtcccggcccggggacgcgaggcccgcgggcgccccgggggcagcagcgcgcgttctgacccccgggactccgcagtgcgcgctgcccccggcggcgcctccgggtgacgaggacgacagcgagcctgtgtacatcgagatgctggggcacgcggccaggcccgatagcccggaccccggggagtccgtgtacgaggagatgaagtgttgcctgcccgacgacggcggcccgggcgcgggctccttcctgctccacggcgcatcgccgcccctgctccaccgcgcgccggaggacgaggcggcggggcccccaggggacgcgtgcgacatcccgccgcccttccccaacctgctgccgcaccggccgcccctgctggtgttccccccgacccccgtcacctgctcccccgcctccgacgagtcgcccctgacacccctggaggtgaagaagctgccagtcctggagaccaacctcaagtaccccgtgcagccggaggggtcgagcccgctgtccccgcagtactccaagagccagaagggcgacggcgacaggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacccaaagccaaactctgcccccgtggccgggccctgcagctccttccccaagatcccatattcccccgtgaaggccaccagggcggacgccaggaaggccggctccagtgcctcgccccccgcgccctacagccctcccagctccaggcctctcagcagccccctggacgagctcgccagcctcttcaactcggggaggagtgtgcttcggaaatccgcggcgggaagaaaaatcagggaagcagaaggttttgaaactaacatgaacataagtagccgagatgaccctagtacgtcagaaattacttccgagactcaagacagaaatgcaaataaccatggaattcagttatctaattcactatctagtgctataactgctgaaaatggaaattccatctcaaatggtttacctgaagaagatggatactcacggttgtctataagtggcacagggacttcgacatttcaaagacacagggacagtcacaccactcaggtaatccatcagctgaggctctcagagaatgaaagtgtggccctgcaggaactcttggactggaggagaaagctctgtgaggaaggacaagactggcagcagatcctgcaccacgctgagcccagggtgcctcccccaccaccttgcaagaagcccagccttctgaagaagccggaaggggcctcctgcaacaggctgccgtctgagctctgggacaccaccatttgatgtggcctgaactgcagacttacaaaatagaactgcctactgattccgggctgcaacaacagaaggctgccttctgacatgcgctggggcttctctccacgcatttagacaaaaaaagcacaggacacagacactaaatatatgagatcccgtgtgtgtgtgtgtgtgtttgtgtgtgtgtgtgtgggttctttcttatccatctcgtggtgatacactctgattttcaagctcctcatttacggctctgtgctacccctaggtagcaagagagaggctgggaaaagtgtggacgtggccagagcgagagagtagcggaggaaaggagcaatccatgcacactctgtacagttgtttttctacggttcaacagtctgtttattgtacttccaatggttttattataatacagtatacgggacatatattttatttctttgtagctacttgtgttttattggtattataaacctgataattatttacatgtttattactgtaattttataaatttatgcaattggtggtgcttcctttcttcaaaatacagattttaaaaaatcatttctagattatttttttcctccacagtccttttttttcacctaacgcacctaaatcttgaaactacattgttgttttagcttcgccagtgtcaccccttgcaaaactatgaattgagccccatgttttaggtgttactcatggatgaggaggctgttctttcctatgccctgtatttctggataagtggattgtgtaccctttagttaaatttcacctcccgacttcagcatagatcacaggaaatcacatggcacacggttaaacacgtatggcttcaaatccatagccggtggtgtaaaatgatcatattcattcaaaggcctacacagtacaaatgagcacgctgccatgtactggtttgagcagtaggggctgcatcgcacagcgctcgtcccccgggacttacactgcatgattccctcactgtatatcctcaaccctcccataatgcaaggccttgttcattgatgtgctttcgtcggctgtcggaaagttctgagcagtggctccagaccaccttgtcttgctacttggaactttttattcataccagcctttgaaaagttactgtgccaataaagaggtacaactgtg

SEQ ID NO: 156568 - DNA, 7436 bp, Homo sapiens
  Payload ID: 10695
  Gene Symbol:
  Gene Name: MYO16
  ENST ID: ENST00000634615
  CDS Start-End: 623-6265
acagatcaaagatctctgattctaagaggtggctattttaagctcctgctatcaatttcctattcacacacagcaactggtggcaactaaaaataatccgctttactaccagctaagaatctggtcatatgtggctgatggacagtgtgcacgaagaagatttaggatccttctatccgtggcttctctccagcccactcatcagcttagtttgctgccatttgaaagctattgaaaagccattaacaggcaggaccgggagagccgcactgcagcacacctccgtgcagcagaatgtggctgcatgtgaacaccaattagagctgactattcccgggattgtggtactcggggctgtgtcaatcaagggtgctacaatagcacgtgcaccagtggtgcctcaagacccaccggggagaggcttatcttaactccagctgccgaatgagaatgagtttgaagctttttgcaggatcatggaacagagcctccatgcaatagtgcatcctgaggtaaactgttacctgagtaagggctttaagtaatgcatttcctgggaacgacagttgtgacagaagagaatgctggaacccgtagcaagattcctgtctgagatggaaagatgtctcactatcattttatcaagtgctgttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaagctctggcccggcccagaccgcacagcgacgactacagcaccatgaagaagattcctcctcgaaagcccaagcgcagccccaacaccaagctcagcggctcctacgaggagatatcggggtcccggcccggggacgcgaggcccgcgggcgccccgggggcagcagcgcgcgttctgacccccgggactccgcagtgcgcgctgcccccggcggcgcctccgggtgacgaggacgacagcgagcctgtgtacatcgagatgctggggcacgcggccaggcccgatagcccggaccccggggagtccgtgtacgaggagatgaagtgttgcctgcccgacgacggcggcccgggcgcgggctccttcctgctccacggcgcatcgccgcccctgctccaccgcgcgccggaggacgaggcggcggggcccccaggggacgcgtgcgacatcccgccgcccttccccaacctgctgccgcaccggccgcccctgctggtgttccccccgacccccgtcacctgctcccccgcctccgacgagtcgcccctgacacccctggaggtgaagaagctgccagtcctggagaccaacctcaagtaccccgtgcagccggaggggtcgagcccgctgtccccgcagtactccaagagccagaagggcgacggcgacaggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacccaaagccaaactctgcccccgtggccgggccctgcagctccttccccaagatcccatattcccccgtgaaggccaccagggcggacgccaggaaggccggctccagtgcctcgccccccgcgccctacagccctcccagctccaggcctctcagcagccccctggacgagctcgccagcctcttcaactcggggaggagtgtgcttcggaaatccgcggcgggaagaaaaatcagggaagcagaaggttttgaaactaacatgaacataagtagccgagatgaccctagtacgtcagaaattacttccgagactcaagacagaaatgcaaataaccatggaattcagttatctaattcactatctagtgctataactgctgaaaatggaaattccatctcaaatggtttacctgaagaagatggatactcacggttgtctataagtggcacagggacttcgacatttcaaagacacagggacagtcacaccactcaggtaatccatcagctgaggctctcagagaatgaaagtgtggccctgcaggaactcttggactggaggagaaagctctgtgaggaaggacaagactggcagcagatcctgcaccacgctgagcccagggtgcctcccccaccaccttgcaagaagcccagccttctgaagaagccggaaggggcctcctgcaacaggctgccgtctgagctctgggacaccaccatttgatgtggcctgaactgcagacttacaaaatagaactgcctactgattccgggctgcaacaacagaaggctgccttctgacatgcgctggggcttctctccacgcatttagacaaaaaaagcacaggacacagacactaaatatatgagatcccgtgtgtgtgtgtgtgtgtttgtgtgtgtgtgtgtgggttctttcttatccatctcgtggtgatacactctgattttcaagctcctcatttacggctctgtgctacccctaggtagcaagagagaggctgggaaaagtgtggacgtggccagagcgagagagtagcggaggaaaggagcaatccatgcacactctgtacagttgtttttctacggttcaacagtctgtttattgtacttccaatggttttattataatacagtatacgggacatatattttatttctttgtagctacttgtgttttattggtattataaacctgataattatttacatgtttattactgtaattttataaatttatgcaattggtggtgcttcctttcttcaaaatacagattttaaaaaatcatttctagattatttttttcctccacagtccttttttttcacctaacgcacctaaatcttgaaactacattgttgttttagcttcgccagtgtcaccccttgcaaaactatgaattgagccccatgttttaggtgttactcatggatgaggaggctgttctttcctatgccctgtatttctggataagtggattgtgtaccctttagttaaatttcacctcccgacttcagcatagatcacaggaaatcacatggcacacggttaaacacgtatggcttcaaatccatagccggtggtgtaaaatgatcatattcattcaaaggcctacacagtacaaatgagcacgctgccatgtactggtttgagcagtaggggctgcatcgcacagcgctcgtcccccgggacttacactgcatgattccctcactgtatatcctcaaccctcccataatgcaaggccttgttcattgatgtgctttcgtcggctgtcggaaagttctgagcagtggctccagaccaccttgtcttgctacttggaactttttattcataccagcctttgaaaagttactgtgccaataaagaggtacaactgtgttcttctatt

SEQ ID NO: 156569 - DNA, 3492 bp, Homo sapiens
  Payload ID: 10695
  Gene Symbol:
  Gene Name: MYO16
  ENST ID: ENST00000634825
  CDS Start-End: 42-2864
caggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaagaggaaggtgcttctgagcaaaaggacagaatttacaatgtacccttttgtatttatacaggaggtgtcagatttttttttttgtaaagggctagagaataaatattttagaccttgtgcaccataagatccttgttgcagttactcacctctgctgttataatgtgaaaaacagctgtagacaatacaaatggatgtgactgtattctgataaaattttatttacaaaaacaggcagtgggccatgtttggctcaggagccatgattgctcactcactctatcataaaagcaaaatatttgtggttgccatcatgttttatgaatctgtgaaatactttgatgcttgtacatatttattaaaagcaagtgtaattcataaataataatttttatttgcaggtactttgcttatagtatctaattcaattttcgtagcatcaaaaagctcccagttgaggaagatggtgaggtctgttgtagaatgtacacaagcagagctgagtctctgagaccactaaccaggtacagtcagggagcttggagacagctcatagagacacacagcaaatacactcattagtgcctaagattagaagtaaagtctacttcactcaaaaggaggcagaaaaaaaaaaaaaaaaaa

SEQ ID NO: 156570 - DNA, 6874 bp, Homo sapiens
  Payload ID: 10695
  Gene Symbol:
  Gene Name: MYO16
  ENST ID: ENST00000634397
  CDS Start-End: 127-5703
ctgcgctcggagactttcagtgaaagcagaggagagatttccaaaggttgtattttccttctggttggagcctctcatccacattgtggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaagctctggcccggcccagaccgcacagcgacgactacagcaccatgaagaagattcctcctcgaaagcccaagcgcagccccaacaccaagctcagcggctcctacgaggagatatcggggtcccggcccggggacgcgaggcccgcgggcgccccgggggcagcagcgcgcgttctgacccccgggactccgcagtgcgcgctgcccccggcggcgcctccgggtgacgaggacgacagcgagcctgtgtacatcgagatgctggggcacgcggccaggcccgatagcccggaccccggggagtccgtgtacgaggagatgaagtgttgcctgcccgacgacggcggcccgggcgcgggctccttcctgctccacggcgcatcgccgcccctgctccaccgcgcgccggaggacgaggcggcggggcccccaggggacgcgtgcgacatcccgccgcccttccccaacctgctgccgcaccggccgcccctgctggtgttccccccgacccccgtcacctgctcccccgcctccgacgagtcgcccctgacacccctggaggtgaagaagctgccagtcctggagaccaacctcaagtaccccgtgcagccggaggggtcgagcccgctgtccccgcagtactccaagagccagaagggcgacggcgacaggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacccaaagccaaactctgcccccgtggccgggccctgcagctccttccccaagatcccatattcccccgtgaaggccaccagggcggacgccaggaaggccggctccagtgcctcgccccccgcgccctacagccctcccagctccaggcctctcagcagccccctggacgagctcgccagcctcttcaactcggggaggagtgtgcttcggaaatccgcggcgggaagaaaaatcagggaagcagaaggttttgaaactaacatgaacataagtagccgagatgaccctagtacgtcagaaattacttccgagactcaagacagaaatgcaaataaccatggaattcagttatctaattcactatctagtgctataactgctgaaaatggaaattccatctcaaatggtttacctgaagaagatggatactcacggttgtctataagtggcacagggacttcgacatttcaaagacacagggacagtcacaccactcaggtaatccatcagctgaggctctcagagaatgaaagtgtggccctgcaggaactcttggactggaggagaaagctctgtgaggaaggacaagactggcagcagatcctgcaccacgctgagcccagggtgcctcccccaccaccttgcaagaagcccagccttctgaagaagccggaaggggcctcctgcaacaggctgccgtctgagctctgggacaccaccatttgatgtggcctgaactgcagacttacaaaatagaactgcctactgattccgggctgcaacaacagaaggctgccttctgacatgcgctggggcttctctccacgcatttagacaaaaaaagcacaggacacagacactaaatatatgagatcccgtgtgtgtgtgtgtgtgtttgtgtgtgtgtgtgtgggttctttcttatccatctcgtggtgatacactctgattttcaagctcctcatttacggctctgtgctacccctaggtagcaagagagaggctgggaaaagtgtggacgtggccagagcgagagagtagcggaggaaaggagcaatccatgcacactctgtacagttgtttttctacggttcaacagtctgtttattgtacttccaatggttttattataatacagtatacgggacatatattttatttctttgtagctacttgtgttttattggtattataaacctgataattatttacatgtttattactgtaattttataaatttatgcaattggtggtgcttcctttcttcaaaatacagattttaaaaaatcatttctagattatttttttcctccacagtccttttttttcacctaacgcacctaaatcttgaaactacattgttgttttagcttcgccagtgtcaccccttgcaaaactatgaattgagccccatgttttaggtgttactcatggatgaggaggctgttctttcctatgccctgtatttctggataagtggattgtgtaccctttagttaaatttcacctcccgacttcagcatagatcacaggaaatcacatggcacacggttaaacacgtatggcttcaaatccatagccggtggtgtaaaatgatcatattcattcaaaggcctacacagtacaaatgagcacgctgccatgtactggtttgagcagtaggggctgcatcgcacagcgctcgtcccccgggacttacactgcatgattccctcactgtatatcctcaaccctcccataatgcaaggccttgttcattgatgtgctttcgtcggctgtcggaaagttctgagcagtggctccagaccaccttgtcttgctacttggaactttttattcataccagcctttgaaaagttactgtgccaataaagaggtacaactgtgttcttctatt

SEQ ID NO: 156571 - DNA, 2361 bp, Homo sapiens
  Payload ID: 10696
  Gene Symbol: MYZAP
  Gene Name: myocardial zonula adherens protein
  Uniprot ID: P0CAP1
  ENST ID: ENST00000267853
  CDS Start-End: 95-1495
gtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaactagtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctactaa

SEQ ID NO: 156572 - DNA, 2181 bp, Homo sapiens
  Payload ID: 10696
  Gene Symbol: MYZAP
  Gene Name: myocardial zonula adherens protein
  Uniprot ID: P0CAP1
  ENST ID: ENST00000380565
  CDS Start-End: 3-1319
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaactagtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttcta

SEQ ID NO: 156573 - DNA, 738 bp, Homo sapiens
  Payload ID: 10696
  Gene Symbol: MYZAP
  Gene Name: myocardial zonula adherens protein
  ENST ID: ENST00000461709
  CDS Start-End: 1-369
caagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcac

SEQ ID NO: 156574 - DNA, 567 bp, Homo sapiens
  Payload ID: 10696
  Gene Symbol: MYZAP
  Gene Name: myocardial zonula adherens protein
  ENST ID: ENST00000569089
  CDS Start-End: 171-567
aataggtgctcagtaactgagtaataaagtatgctgagtccagcttcctgctttgatctcctggaaggaacccttgcccccagggacagctggttcggtagcagtggtgttcagggcactgccaagcctggggcatctctggagattgtgtatccgagtttcaggagaccatggagatcagcctcgtaaaatgctcggaggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggaga

SEQ ID NO: 156575 - DNA, 2817 bp, Homo sapiens
  Payload ID: 10697
  Gene Symbol: MYOCD
  Gene Name: myocardin
  Uniprot ID: Q8IZQ8
  ENST ID: ENST00000343344
  CDS Start-End: 1-2817
atgacactcctggggtctgagcattccttgctgattaggagcaagttcagatcagttttacagttaagacttcaacaaagaaggacccaggaacaactggctaaccaaggcataataccaccactgaaacgtccagctgaattccatgagcaaagaaaacatttggatagtgacaaggctaaaaattccctgaagcgcaaagccagaaacaggtgcaacagtgccgacttggttaatatgcacatactccaagcttccactgcagagaggtccattccaactgctcagatgaagctgaaaagagcccgactcgccgatgatctcaatgaaaaaattgctctacgaccagggccactggagctggtggaaaaaaacattcttcctgtggattctgctgtgaaagaggccataaaaggtaaccaggtgagtttctccaaatccacggatgcttttgcctttgaagaggacagcagcagcgatgggctttctccggatcagactcgaagtgaagacccccaaaactcagcgggatccccgccagacgctaaagcctcagataccccttcgacaggttctctggggacaaaccaggatcttgcttctggctcagaaaatgacagaaatgactcagcctcacagcccagccaccagtcagatgcggggaagcaggggcttggcccccccagcacccccatagccgtgcatgctgctgtaaagtccaaatccttgggtgacagtaagaaccgccacaaaaagcccaaggaccccaagccaaaggtgaagaagcttaaatatcaccagtacattcccccagaccagaaggcagagaagtcccctccacctatggactcagcctacgctcggctgctccagcaacagcagctgttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagatggctggtttacactcttctgataaggtggggccaaagttttcaattccatccccaactttttctaagtcaagttcagcaatttcagaggtaacacagcctccatcctatgaagatgccgtaaagcagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtag

SEQ ID NO: 156576 - DNA, 3632 bp, Homo sapiens
  Payload ID: 10697
  Gene Symbol: MYOCD
  Gene Name: myocardin
  ENST ID: ENST00000443061
  CDS Start-End: 1-1947
ttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagaactcaggagcacacgatggccatcctccaagcttctctccccattcttccagcctccacccgcccttctctggagcccaagcagacagcagtcatggtgccgggggaaacccttgtcccaaaagcccatgtgtacagcaaaagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtagaatgcccaatgcaccagtgctatggaagaccaatggagttccatgggggaaagcacacagccatacatactttactgtccaaaaacagaagaagaagaagagaattaaaaagaagcaatgatttctgtgccaatgaacaagaacaaaagtcatttttagaaatacatatactgtaatatttaccaacagtcagtaactgttaatgatttcaacaatgcattaaaagaatgtgctttctcagattaaggatgccaaaaaagatatttcactgccttttcaaagaccagtatattttctagcccataatttttctcaggcattgttggggcataagctcacactgtaagcttttctcatgaattcactagacataacgtggaaggaaaacgtagtcttttgggagtacagggaagccagcccctcaaagcttatggaagacatacctgcaatggaagctgttgcccaatgtctccattactatctttcaaaagagaagccagacccagcttcagatcaaaagttcttgagacagaggaacaaaaccaatcgatttccagggaagctaatcaactctcttttccctctaccacaaaactgccctgctggagtggttctgaacctgtacccaggactcgatgtggtcactaataacaattaacctgaactgagtccacagaactccactcggaactttcttcttttttaactagtggcccaatcattcccaccatctctgtgctgataagtacgtgtcctagatgagaaccctgaagaatgcagaccttcttcccccgaaggagatgccacaagctctccaacacagccccctttagttccaaagactagagatgaccacattggtagaagtatatctcgaggcacaggaagggagccccaccagggataattcagacaggactagagaataacatcatttcacataccctgggataaacaccctgggttcctatagaaggactattacttatgggagtccaacttctccttttgttttgttattatcagtttatctttctcccactccacttttccttcaaggtaccaatcctttcctgttcctcgtttggccatctttctttttctgcctccacattgggaggggaggacttctcagttctaacaagctgccatactcctaagaaagccatttttgaaaaatttaacaatccaggttcttctggagaactcattctccacacgcacagtttgctgcaaaaggaagttgcaagaatttcttgaggaagaaactggtgacttggtccatcagtcacgaagttctttctattctcgtttagttttcaagaaattattggtttgtgttgctctggggaaattggaaatcattacattgtaaagacaaatatggatgatatttacaagagagaatttcagatctgggtttttgaaagaaaacagaattgcgcattgaaaacgatggaaggaaaaagacaatggtctaatgtgcattcctcattacctctcgtggctttggctgggagttggaaaaagctaaaatttcagaacagtctctgtaaggctctctgtggctccagttcaccattttatattgttgcatgctgtagaaaggagctattgctgttgttttgtttttttatttaaatcactaaggcactgtttttatcttttgtaaaaaaaaaaaaaaa

SEQ ID NO: 156577 - DNA, 8466 bp, Homo sapiens
  Payload ID: 10697
  Gene Symbol: MYOCD
  Gene Name: myocardin
  Uniprot ID: Q8IZQ8
  ENST ID: ENST00000425538
  CDS Start-End: 201-3161
aattagccccgcacggcgaggggggaggcgccagttttctggggacactggctgccactgtactcctacccaggggagctcacggagagttggatgaattctgggttgttagctgcggtcagctgggctcccgggagcctgttgctggtggagaacagggggcgcctggccaagggaccagcggcttgctgagactcaacatgacactcctggggtctgagcattccttgctgattaggagcaagttcagatcagttttacagttaagacttcaacaaagaaggacccaggaacaactggctaaccaaggcataataccaccactgaaacgtccagctgaattccatgagcaaagaaaacatttggatagtgacaaggctaaaaattccctgaagcgcaaagccagaaacaggtgcaacagtgccgacttggttaatatgcacatactccaagcttccactgcagagaggtccattccaactgctcagatgaagctgaaaagagcccgactcgccgatgatctcaatgaaaaaattgctctacgaccagggccactggagctggtggaaaaaaacattcttcctgtggattctgctgtgaaagaggccataaaaggtaaccaggtgagtttctccaaatccacggatgcttttgcctttgaagaggacagcagcagcgatgggctttctccggatcagactcgaagtgaagacccccaaaactcagcgggatccccgccagacgctaaagcctcagataccccttcgacaggttctctggggacaaaccaggatcttgcttctggctcagaaaatgacagaaatgactcagcctcacagcccagccaccagtcagatgcggggaagcaggggcttggcccccccagcacccccatagccgtgcatgctgctgtaaagtccaaatccttgggtgacagtaagaaccgccacaaaaagcccaaggaccccaagccaaaggtgaagaagcttaaatatcaccagtacattcccccagaccagaaggcagagaagtcccctccacctatggactcagcctacgctcggctgctccagcaacagcagctgttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagaactcaggagcacacgatggccatcctccaagcttctctccccattcttccagcctccacccgcccttctctggagcccaagcagacagcagtcatggtgccgggggaaacccttgtcccaaaagcccatgtgtacagcaaaagatggctggtttacactcttctgataaggtggggccaaagttttcaattccatccccaactttttctaagtcaagttcagcaatttcagaggtaacacagcctccatcctatgaagatgccgtaaagcagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtagaatgcccaatgcaccagtgctatggaagaccaatggagttccatgggggaaagcacacagccatacatactttactgtccaaaaacagaagaagaagaagagaattaaaaagaagcaatgatttctgtgccaatgaacaagaacaaaagtcatttttagaaatacatatactgtaatatttaccaacagtcagtaactgttaatgatttcaacaatgcattaaaagaatgtgctttctcagattaaggatgccaaaaaagatatttcactgccttttcaaagaccagtatattttctagcccataatttttctcaggcattgttggggcataagctcacactgtaagcttttctcatgaattcactagacataacgtggaaggaaaacgtagtcttttgggagtacagggaagccagcccctcaaagcttatggaagacatacctgcaatggaagctgttgcccaatgtctccattactatctttcaaaagagaagccagacccagcttcagatcaaaagttcttgagacagaggaacaaaaccaatcgatttccagggaagctaatcaactctcttttccctctaccacaaaactgccctgctggagtggttctgaacctgtacccaggactcgatgtggtcactaataacaattaacctgaactgagtccacagaactccactcggaactttcttcttttttaactagtggcccaatcattcccaccatctctgtgctgataagtacgtgtcctagatgagaaccctgaagaatgcagaccttcttcccccgaaggagatgccacaagctctccaacacagccccctttagttccaaagactagagatgaccacattggtagaagtatatctcgaggcacaggaagggagccccaccagggataattcagacaggactagagaataacatcatttcacataccctgggataaacaccctgggttcctatagaaggactattacttatgggagtccaacttctccttttgttttgttattatcagtttatctttctcccactccacttttccttcaaggtaccaatcctttcctgttcctcgtttggccatctttctttttctgcctccacattgggaggggaggacttctcagttctaacaagctgccatactcctaagaaagccatttttgaaaaatttaacaatccaggttcttctggagaactcattctccacacgcacagtttgctgcaaaaggaagttgcaagaatttcttgaggaagaaactggtgacttggtccatcagtcacgaagttctttctattctcgtttagttttcaagaaattattggtttgtgttgctctggggaaattggaaatcattacattgtaaagacaaatatggatgatatttacaagagagaatttcagatctgggtttttgaaagaaaacagaattgcgcattgaaaacgatggaaggaaaaagacaatggtctaatgtgcattcctcattacctctcgtggctttggctgggagttggaaaaagctaaaatttcagaacagtctctgtaaggctctctgtggctccagttcaccattttatattgttgcatgctgtagaaaggagctattgctgttgttttgtttttttatttaaatcactaaggcactgtttttatcttttgtaaaaaaaaaaaaaaagttgttcactgtgcacttatagaaaaaataatcaaaaatgttgggattttagaagctctctttttgataaaccaaagatttagaagtcattccattgttaacttgtaaaaatgtgtgaacacagagagtttttggtgattgctactctgaaagctgccagatcttattctgggggtgggatgtggaggaatacacatacacacacaaacatacatgtatgtataatagatatatacatatgtgtatattatatctgtgtgtgcatgtatctccaaaagcggcgttacagagttctacaccaaaagcctttaacccttaatctgctgtgaatgatacctggcctttctcactatgaatttctgattaaccaaccagactacacgttgcctctctgtgtatgactaacggctccaacccgatgactcacagctacttgcttatcgtgaacaagctcatcttggcaatgaatatggatgtgaaaagacagaacagcttcaccattagtagctggaaatggtatcacagtctcttatagaggaatatgaaaggaacaagaaaatcattttacattccttttatctgtattgtgctttaaaagatccacatggtaaattttttattttgcttttatgtcagtcatcagaaccaaaaaaatccagaagaaaaaattgccagtgtttcctttgaagatgaagctactggggaagaaaaccttattaatacactccacacatttgttcattcctcagctgttggtgttttcttggggtcttgacaaagcttgctggtcagtgcacttttcaggtgtcacgttttgctgtttgtatgttttttcttccccttacttcctttggaaaacaaactcacacagtgcccctactctgagacctgggactgagtgttaattattttttccttgggtatttctatctgagagactagacctagttaggaggcctctgtacttctccagattgtacctttttatggggatctttgaggctatgacccaggactgatagatatgccttacggaagacaaaagataaaatggttcctatatcctaatgcaaaccaacacagttaaaagagcagatctctggataactgctctcaacctgcttctacagtctccacaaaccgcattcaccctctctcttcatagctcagacatgaaatttgagggagaaaactggagataattgggagaaaattgatgaagttggctgcttccagtagatcagataatccatgaatttgtctcccattgagaattttattttaaattcttttaaactcttcgttgtgtcttttgtgatgacaaatcaggcatgactaaaagatgtacagagacttacgaagatggtcacattcaagttccctaatgctcttagaacctgaagatgaccatgtgtagttttcttaagacctctgaacccccatggtgatgaagacttgaagacatttgcagctatctgctgcagtctggtagattcatacttatctaaagaagtcaaaaaatttattcgtgcaagtgcttgcaggaagccagtgcttattagtagtgaccctgcttctatcaacgttattgagacaacacatattctattctaagggagaaagagggaggaagagagggagggagggaggaagaagagggagggagcgaggaaggaagataggagatgggtaggggggtaaagagaaaaggagggagaagggaaggaaggaaagaagagaggaaagaaaggagggaaggaaaaaagggccaaactttctgatctatgaacttctcagttcagctgtcacattatgagaagtaaatcagaatttttttaaggagaagtcattcttagcactacaataattgtaccagtaattgaggaaaccaagacaatcttcacctgaataatagagggtctgagaactgtcagccttttgccattcaaaaacatttatgtccaacctgaaaaaaaagcatcaataaaacctatcccaagcattcaaaatagtcctttccaaatgttatttattttaaagtcaatcagctcttttagaaacagattctggtctggctgaaaactcccacaacaaatttactcatccagtggctaatatttaatgcccaccatgggcagagcacacaaatcttcagataaacaatactgaattgattcagcacagattgttcagatttgaatgaccagggagttgtatttgcacatgcaagaacactaagaatctcccagtcctcaaactagaaacctttcagctacgatgaaaaaaaaaaaggggtcttcatttttccaagagggggtggaggtggggatcactttttagctaaaagctatctctcacttcaaaattcttgtctttttctttgtggacaaacaccagtagtctatcacttggagatcttttaatatctcccatcatttaaaacatccacgagagtttgaagatttgtgttgattgccagatacagaagccccttgaaaataaggaaagggtggaggaagcatttttgtgtcctatccctacttatcgtagcagctctatagacaaaagggacacttactggtgagcctctggcccttaaaagaaaatcatctaagaatatgaaggcaatttgatttccccccacagccctcagctgccttcctcacagaaggaagttcccaaaattgctggtacacagtttgcaatcaaatatcagatatgagaaaacctgtagtgaagagtctgggttcttggttttctcataaatccaatataaatttgtaggttggttcagggtcaaaattgccagtgctttattagacagatgatactgatagacacacagagcccaggtcctggaacaagacaatcctgtagtgccaagatctggtcagttgcgttaaggagctgggtttgattctagagtccaggtttatagagaaaccctggctagattgagcctacccatggggagacgatttcaagacaggatgagatctgggaagaattttgttgtcatctgccagggaaattatcacaggactcattgaatgcaataacatgtgagtaagttcccttttgattctgggaatcagcgattttccctgtggattaagacaaaccaacgccagaaggtctcctgtgcttattttaaccatctgctcccatcgtgaaccctggagcatgcatttcctagaagtggtttcatagctcctgtgtgttcatggaaaaggggagtataatgatggggatgctggaagcttttttaatgttttccaaaggaaaggaacccacactgctccccagagttcctttccaatggccctgcagtaagaacggaggacaatgtattgctgggtgcttaaaatcctccctcagtgaagcacaaagagacactttgtaaagaaaaaaagagcaagcataggttctctgtgggaccttgtggagtggtgttttcacgttggtctctttggctcaattgagcataatcagaaagaaatgtgggttattgggaagagacaaaaagcagtggctaaaataccaaagttggcatgtgttcttttttaaaaaaaaaaaaaaatgcatatatttttaaataaaatgtttattttaaaaagaaa

SEQ ID NO: 156578 - DNA, 565 bp, Homo sapiens
  Payload ID: 10697
  Gene Symbol: MYOCD
  Gene Name: myocardin
  ENST ID: ENST00000579237
  CDS Start-End: 300-425
aatcgccggcagcctatgacatcagacaggaacgcctgggatgccgcgctgctcctggccaacctccgaggaggaggagggtcccgccggctaagagttaattagccccgcacggcgaggggggaggcgccagttttctggggacactggctgccactgtactcctacccaggggagctcacggagagttggatgaattctgggttgttagctgcggtcagctgggctcccgggagcctgttgctggtggagaacagggggcgcctggccaagggaccagcggcttgctgagactcaacatgacactcctggggtctgagcattccttgctgattaggagcaagttcagatcagttttacagttaagacttcaacaaagaaggacccaggaacaactggctaaccaaggcataataccacactaatccaagctacagcagccacatacttactgcaaaaccttgcactgaaacgtccagctgaattccatgagcaaagaaaacatttggatagtgacaaggctaaaaattccctgaagcgcaaagccagaaacaggtgcaacagt

SEQ ID NO: 156579 - DNA, 2095 bp, Homo sapiens
  Payload ID: 10698
  Gene Symbol: MYOC
  Gene Name: myocilin, trabecular meshwork inducible glucocorticoid response
  Uniprot ID: Q99972
  ENST ID: ENST00000037502
  CDS Start-End: 73-1587
agcaaggccacccatccaggcacctctcagcacagcagagctttccagaggaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaagtttctacgtggaatttggacactttggccttccaggaactgaagtccgagctaactgaagttcctgcttcccgaattttgaaggagagcccatctggctatctcaggagtggagagggagacaccggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaa

SEQ ID NO: 156580 - DNA, 2042 bp, Homo sapiens
  Payload ID: 10698
  Gene Symbol: MYOC
  Gene Name: myocilin, trabecular meshwork inducible glucocorticoid response
  ENST ID: ENST00000614688
  CDS Start-End: 23-1057
gaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaagtttctacgtggaatttggacactttggccttccaggaactgaagtccgagctaactgaagttcctgcttcccgaattttgaaggagagcccatctggctatctcaggagtggagagggagacaccggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttcagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttaccc

SEQ ID NO: 156581 - DNA, 5464 bp, Homo sapiens
  Payload ID: 10699
  Gene Symbol: MEF2A
  Gene Name: myocyte enhancer factor 2A
  Uniprot ID: Q02078
  ENST ID: ENST00000338042
  CDS Start-End: 320-1813
agaacgagttccggtctggccgaggcttgtctcctaaaaatagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacgatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgct

SEQ ID NO: 156582 - DNA, 5824 bp, Homo sapiens
  Payload ID: 10699
  Gene Symbol: MEF2A
  Gene Name: myocyte enhancer factor 2A
  Uniprot ID: Q02078
  ENST ID: ENST00000354410
  CDS Start-End: 630-2129
atagtccgcccccacgtccttgtggaatagcgcccgcttccaagcaccgtgactctctttgccctacccttgtctttcccattccaattactctagaacccaccgagaggataattcagtcctgaaaagaaactgatggggagaagcgaggaagggaacccaggagggaggggaggcagggctgcggagggacaccgaggcggcggaggtagtgcgcacgcgcagcacagaacgagttccggtctggccgaggcttgtctcctaaaaatagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgctaaaggttgttgtaaactgtttgtctcccgcactcactccagtaa

SEQ ID NO: 156583 - DNA, 5182 bp, Homo sapiens
  Payload ID: 10699
  Gene Symbol: MEF2A
  Gene Name: myocyte enhancer factor 2A
  Uniprot ID: Q02078
  ENST ID: ENST00000449277
  CDS Start-End: 258-1547
gcgcggatgtcccggcgagtcccgggctgaaagaggcggctccgggcggcgcgaagcgctggtggcgggcccgggctgcggcgtgtgcgcgcccgccagctgctccggagatacgatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaa

SEQ ID NO: 156584 - DNA, 574 bp, Homo sapiens
  Payload ID: 10699
  Gene Symbol: MEF2A
  Gene Name: myocyte enhancer factor 2A
  ENST ID: ENST00000559903
  CDS Start-End: 342-574
agtcgcgcgggctggtggcgagcagcctccccgggcgcgcaccccttggggccggggggcggtggtggacgtcgcctccttgaaagttgaaggagttctcgggagaccccggagaaggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaag

SEQ ID NO: 156585 - DNA, 5413 bp, Homo sapiens
  Payload ID: 10699
  Gene Symbol: MEF2A
  Gene Name: myocyte enhancer factor 2A
  Uniprot ID: Q02078
  ENST ID: ENST00000557942
  CDS Start-End: 243-1760
agctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgctaa

SEQ ID NO: 156586 - DNA, 2854 bp, Homo sapiens
  Payload ID: 10699
  Gene Symbol: MEF2A
  Gene Name: myocyte enhancer factor 2A
  Uniprot ID: Q02078
  ENST ID: ENST00000557785
  CDS Start-End: 350-1843
ggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaac

SEQ ID NO: 156587 - DNA, 732 bp, Homo sapiens
  Payload ID: 10699
  Gene Symbol: MEF2A
  Gene Name: myocyte enhancer factor 2A
  ENST ID: ENST00000560493
  CDS Start-End: 478-732
gatttgccacgcgccgcgtcaccgggccgctcccggcctgggctcccgggggctggtcagggaggtggcggcggctgagcggcggagcgggggcggcagggcgcgacgccgccgggccgccccgccctgggaggcgcccgggccctcatcaagtgaccagtatcccttccaggggaacacggtccttcagaggaaagcgagctccaacccgcggccccggcgccaagccgccgtcatcttcttcctgtgccaggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgtt

SEQ ID NO: 156588 - DNA, 565 bp, Homo sapiens
  Payload ID: 10699
  Gene Symbol: MEF2A
  Gene Name: myocyte enhancer factor 2A
  ENST ID: ENST00000558049
  CDS Start-End: 451-565
cgtgcgcggatgtcccggcgagtcccgggctgaaagaggcggctccgggcggcgcgaagcgctggtggcgggcccgggctgcggcgtgtgcgcgcccgccagctgctccggagatacggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctct

SEQ ID NO: 156589 - DNA, 2186 bp, Homo sapiens
  Payload ID: 10699
  Gene Symbol: MEF2A
  Gene Name: myocyte enhancer factor 2A
  Uniprot ID: Q02078
  ENST ID: ENST00000558812
  CDS Start-End: 320-1633
agaacgagttccggtctggccgaggcttgtctcctaaaaatagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacgatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaatacccagaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatatt

SEQ ID NO: 156590 - DNA, 1429 bp, Homo sapiens
  Payload ID: 10700
  Gene Symbol: MEF2B
  Gene Name: myocyte enhancer factor 2B
  ENST ID: ENST00000410050
  CDS Start-End: 74-1201
ccgcgggtccgtgcgcccagcgtcccagggcccaggccgagcagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagcccccaattcctgcccaccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggacca

SEQ ID NO: 156591 - DNA, 1683 bp, Homo sapiens
  Payload ID: 10700
  Gene Symbol: MEF2B
  Gene Name: myocyte enhancer factor 2B
  ENST ID: ENST00000409224
  CDS Start-End: 89-982
atcttcgtgcagccgccgcgggtccgtgcgcccagcgtcccagggcccaggccgagcagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgaggtaccccagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccaggtaagtgccctgagacgacggcaagtcccagtcctccaaagccccggccgctgctgacccctggtggccatccctggtactgcgcacacttccggtacggatgggcagctattttgaggccccaagagggaccgccaccccctcctttcccagggtcctcctgccaagcctttgcccacgctgtgccatcccctggcttccttcccttcctcgctgagctcacggcctccctctctctttccccctgcagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccag

SEQ ID NO: 156592 - DNA, 1297 bp, Homo sapiens
  Payload ID: 10700
  Gene Symbol: MEF2B
  Gene Name: myocyte enhancer factor 2B
  ENST ID: ENST00000409447
  CDS Start-End: 233-1093
aaggcacctgcggccgcgggcccctgatcttcgtgcagccgccgcgggtccgtgcgcccagcgtcccagggcccaggccgagcagcaatgcatgagagctggaagtggaagagcttacaagatcatcatcgctcactgtaaccttgaactcctgggctcacagaatcctcccgtctcaggctcccacatagccaggactacagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccagagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataa

SEQ ID NO: 156593 - DNA, 1405 bp, Homo sapiens
  Payload ID: 10700
  Gene Symbol: MEF2B
  Gene Name: myocyte enhancer factor 2B
  Uniprot ID: Q02080
  ENST ID: ENST00000424583
  CDS Start-End: 71-1177
cgggtccgtgcgcccagcgtcccagggcccaggccgagcagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggacca

SEQ ID NO: 156594 - DNA, 6192 bp, Homo sapiens
  Payload ID: 10701
  Gene Symbol: MEF2C
  Gene Name: myocyte enhancer factor 2C
  Uniprot ID: Q06413
  ENST ID: ENST00000340208
  CDS Start-End: 378-1829
caaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 156595 - DNA, 6336 bp, Homo sapiens
  Payload ID: 10701
  Gene Symbol: MEF2C
  Gene Name: myocyte enhancer factor 2C
  Uniprot ID: Q06413
  ENST ID: ENST00000424173
  CDS Start-End: 582-1973
agcaattctgtgttcttttgccagcactgacaaaggtctggttgtcagtgatacctttacagctaaatttactccagagtgacagaaacaggtgcacctcggcctgccagacacttgtgcagagagatcacgcatctcacggcttgacgatcaagggggcaaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 156596 - DNA, 4340 bp, Homo sapiens
  Payload ID: 10701
  Gene Symbol: MEF2C
  Gene Name: myocyte enhancer factor 2C
  Uniprot ID: Q06413
  ENST ID: ENST00000437473
  CDS Start-End: 652-2073
gagctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaa

SEQ ID NO: 156597 - DNA, 7561 bp, Homo sapiens
  Payload ID: 10701
  Gene Symbol: MEF2C
  Gene Name: myocyte enhancer factor 2C
  Uniprot ID: Q06413
  ENST ID: ENST00000504921
  CDS Start-End: 653-2074
gctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgatgcagtgtccgtggtgcatttttttaaattaatgttttgctgtttaaatttattcaattttattgtgttttttaaaaagcagcttatgccacaagcacaaatgagctttctcagttttcaactcaaaatattatatgaaaagatggatatgtgtgtctgtgtgggaggggtgtgaattggatgacggttcttagggtattacagaattcagccagtggtggaagtctaaggttcttattgaatggttcaacttctttatcaaagaagttccatgaagatctttgataacctgtttaaatgtacagaatttttcaaaagccactgtgaaaagcagtaccataagttattttttaactaaaatctgtagaaagtgtttccaaaagagttccttttttcttcttcgaagtaatttctaaaagttgaaaacataggcttataaatctgaataaattagtgaattcatacattttagagactatcaaatatatccattattaacattcaataataatctctaaaggggaatgtccttaaaaagattgatagaaagattaatttaaaaactgaaaaggaaaacaagacaccaccagttagccagctggagaacttggacttttgcattagtagtgatatctgctccaaaaagaatgcagttcgaggaaatgttgcatgtggcttcaaaatagcagtgctttctgctttgttctcttgtattcattttcagcaaacatgtattaagcaattattatatgtaactcatgtggtgattccaggatgaatgaagttgtagccctttctcttaggaaacttataaactaataggagataaaaggcattctcagggaagtctacaaagtgctatgagggagccactttggccatcctggggcagagcagaccagaggctcagagcatggacacttcctcatccacccagcagaagcctttcacttgattttgaaggtgggcaggattgagaaaggcccagaaggggatgagttcaaagctgtttgtgggcatgtgacccctgcagtcacatatggccctagcttgtgtttcgtttagtgttctgctatcattatcctgataatatcctgataataaaattatccttaataatttta

SEQ ID NO: 156598 - DNA, 3446 bp, Homo sapiens
  Payload ID: 10701
  Gene Symbol: MEF2C
  Gene Name: myocyte enhancer factor 2C
  ENST ID: ENST00000510942
  CDS Start-End: 370-1671
gcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatccca

SEQ ID NO: 156599 - DNA, 1882 bp, Homo sapiens
  Payload ID: 10701
  Gene Symbol: MEF2C
  Gene Name: myocyte enhancer factor 2C
  Uniprot ID: Q06413
  ENST ID: ENST00000508569
  CDS Start-End: 370-1767
gtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaa

SEQ ID NO: 156600 - DNA, 854 bp, Homo sapiens
  Payload ID: 10701
  Gene Symbol: MEF2C
  Gene Name: myocyte enhancer factor 2C
  ENST ID: ENST00000506716
  CDS Start-End: 174-854
atgaattagctgccctacttagcatacacagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacct

SEQ ID NO: 156601 - DNA, 1063 bp, Homo sapiens
  Payload ID: 10701
  Gene Symbol: MEF2C
  Gene Name: myocyte enhancer factor 2C
  ENST ID: ENST00000513252
  CDS Start-End: 336-1063
catcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaa

SEQ ID NO: 156602 - DNA, 623 bp, Homo sapiens
  Payload ID: 10701
  Gene Symbol: MEF2C
  Gene Name: myocyte enhancer factor 2C
  ENST ID: ENST00000507984
  CDS Start-End: 263-623
ctttagcatctgtccagaagaaattcttctcgacttgggtctcaaaccactttgccttcatctgcctgcttatgccaaactcaaaatgagcagaagcctgccataatgaagttcccctttttagaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaag

SEQ ID NO: 156603 - DNA, 2772 bp, Homo sapiens
  Payload ID: 10701
  Gene Symbol: MEF2C
  Gene Name: myocyte enhancer factor 2C
  Uniprot ID: Q06413
  ENST ID: ENST00000514015
  CDS Start-End: 413-1738
acacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagca

SEQ ID NO: 156604 - DNA, 3469 bp, Homo sapiens
  Payload ID: 10701
  Gene Symbol: MEF2C
  Gene Name: myocyte enhancer factor 2C
  ENST ID: ENST00000506554
  CDS Start-End: 361-1560
acttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagcca

SEQ ID NO: 156605 - DNA, 557 bp, Homo sapiens
  Payload ID: 10701
  Gene Symbol: MEF2C
  Gene Name: myocyte enhancer factor 2C
  ENST ID: ENST00000508610
  CDS Start-End: 180-557
acatttcttcccttggagaattgaagcaaatatgcagtacgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatcta

SEQ ID NO: 156606 - DNA, 773 bp, Homo sapiens
  Payload ID: 10701
  Gene Symbol: MEF2C
  Gene Name: myocyte enhancer factor 2C
  ENST ID: ENST00000503075
  CDS Start-End: 512-773
cacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatacttcttaggaaaggcagcattttacttcattcattaattgcaccatttacgtcctgattgctgtgcatgtggaatatattgaaagataatattaaagtgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgt

SEQ ID NO: 156607 - DNA, 3393 bp, Homo sapiens
  Payload ID: 10701
  Gene Symbol: MEF2C
  Gene Name: myocyte enhancer factor 2C
  Uniprot ID: Q06413
  ENST ID: ENST00000514028
  CDS Start-End: 289-1614
gctaaatgaaaggaaaggaaattgtcctatatgcatttgctgtggattcatggattggctttctgtgatagagaaagcttgtttgtatctttggggtcttaaacgtgcatgggaaataccattctaacacactgcttgcttctaagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaa

SEQ ID NO: 156608 - DNA, 609 bp, Homo sapiens
  Payload ID: 10701
  Gene Symbol: MEF2C
  Gene Name: myocyte enhancer factor 2C
  ENST ID: ENST00000502983
  CDS Start-End: 223-609
gaagctgcttcctcggtaaatatttccaaactgattagaaagttcatggccccgcgatgaagtcgagatctcaaatactgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagc

SEQ ID NO: 156609 - DNA, 851 bp, Homo sapiens
  Payload ID: 10701
  Gene Symbol: MEF2C
  Gene Name: myocyte enhancer factor 2C
  ENST ID: ENST00000502831
  CDS Start-End: 268-851
aaattgtcctatatgcatttgctgtggattcatggattggctttctgtgatagagaaagcttgtttgtatctttggggtcttaaacgtgcatgggaaataccattctaacacactgcttgcttctaaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaa

SEQ ID NO: 156610 - DNA, 573 bp, Homo sapiens
  Payload ID: 10701
  Gene Symbol: MEF2C
  Gene Name: myocyte enhancer factor 2C
  ENST ID: ENST00000509373
  CDS Start-End: 488-573
aatttttcataacgggtgaaattgtcacctaatttcattaaaaagattaggaaactttttacaaaaaaaaatacatttcaagtgttagtctttaaaaaagcatagtttgcatcatttaaatgacttgttaaattacttatgagatcattttaattgttaaaaaataaaactacttgatctgctcctgtctgtgatataccatatatttttaacaaaaaagttatttttattcattttattgctttagctccatatagtttatttccttgataaaattagaatatgatagttcttatgaaactgacttgctgttagagtggtatttaatttttcttttttgttcagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgat

SEQ ID NO: 156611 - DNA, 914 bp, Homo sapiens
  Payload ID: 10701
  Gene Symbol: MEF2C
  Gene Name: myocyte enhancer factor 2C
  ENST ID: ENST00000631026
  CDS Start-End: 300-914
gtttgtaaatgagatagcccagtgggagaatgatctttagcatctgtccagaagaaattcttctcgacttgggtctcaaaccactttgccttcatctgcctgcttatgccaaactcaaaatgagcagaagcctgccataatgaagttcccctttttacaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggt

SEQ ID NO: 156612 - DNA, 2393 bp, Homo sapiens
  Payload ID: 10701
  Gene Symbol: MEF2C
  Gene Name: myocyte enhancer factor 2C
  ENST ID: ENST00000627659
  CDS Start-End: 419-1714
aaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatg

SEQ ID NO: 156613 - DNA, 2851 bp, Homo sapiens
  Payload ID: 10701
  Gene Symbol: MEF2C
  Gene Name: myocyte enhancer factor 2C
  Uniprot ID: Q06413
  ENST ID: ENST00000629612
  CDS Start-End: 427-1824
aagggggcaaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggt

SEQ ID NO: 156614 - DNA, 815 bp, Homo sapiens
  Payload ID: 10701
  Gene Symbol: MEF2C
  Gene Name: myocyte enhancer factor 2C
  ENST ID: ENST00000627717
  CDS Start-End: 1-552
ggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaa

SEQ ID NO: 156615 - DNA, 722 bp, Homo sapiens
  Payload ID: 10701
  Gene Symbol: MEF2C
  Gene Name: myocyte enhancer factor 2C
  ENST ID: ENST00000627170
  CDS Start-End: 1-456
gcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaa

SEQ ID NO: 156616 - DNA, 1182 bp, Homo sapiens
  Payload ID: 10701
  Gene Symbol: MEF2C
  Gene Name: myocyte enhancer factor 2C
  ENST ID: ENST00000626391
  CDS Start-End: 1-1182
atggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatga

SEQ ID NO: 156617 - DNA, 1254 bp, Homo sapiens
  Payload ID: 10701
  Gene Symbol: MEF2C
  Gene Name: myocyte enhancer factor 2C
  Uniprot ID: Q06413
  ENST ID: ENST00000628656
  CDS Start-End: 1-1254
atggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatga

SEQ ID NO: 156618 - DNA, 4343 bp, Homo sapiens
  Payload ID: 10701
  Gene Symbol: MEF2C
  Gene Name: myocyte enhancer factor 2C
  Uniprot ID: Q06413
  ENST ID: ENST00000625674
  CDS Start-End: 374-1765
aaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaa

SEQ ID NO: 156619 - DNA, 632 bp, Homo sapiens
  Payload ID: 10701
  Gene Symbol: MEF2C
  Gene Name: myocyte enhancer factor 2C
  ENST ID: ENST00000503554
  CDS Start-End: 325-632
attttagtttagctccctgagacatgaaattctcttgttcagtctgtatccccttaacatgccaacatttagtctctttcttaaaattattattttcactcaagcagatttttacttttaatctttaaaatgatgtagaaactactttgaaaaatagcatttctggagtaggatggcttttagtttcaacaaatggaattctgaacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacc

SEQ ID NO: 156620 - DNA, 3467 bp, Homo sapiens
  Payload ID: 10701
  Gene Symbol: MEF2C
  Gene Name: myocyte enhancer factor 2C
  ENST ID: ENST00000625585
  CDS Start-End: 273-1688
ggaaattgtcctatatgcatttgctgtggattcatggattggctttctgtgatagagaaagcttgtttgtatctttggggtcttaaacgtgcatgggaaataccattctaacacactgcttgcttctaagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaa

SEQ ID NO: 156621 - DNA, 5965 bp, Homo sapiens
  Payload ID: 10702
  Gene Symbol: MEF2D
  Gene Name: myocyte enhancer factor 2D
  Uniprot ID: Q14814
  ENST ID: ENST00000348159
  CDS Start-End: 482-2047
ctcaagctaggctgagctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaccattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgata

SEQ ID NO: 156622 - DNA, 3194 bp, Homo sapiens
  Payload ID: 10702
  Gene Symbol: MEF2D
  Gene Name: myocyte enhancer factor 2D
  Uniprot ID: Q14814
  ENST ID: ENST00000360595
  CDS Start-End: 215-1759
ggggcctgagaccacccctgccctaggcccagctttcctggactgcctgcccccacaaaccaacagcccgcccccaggtccccagtcgaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacga

SEQ ID NO: 156623 - DNA, 1905 bp, Homo sapiens
  Payload ID: 10702
  Gene Symbol: MEF2D
  Gene Name: myocyte enhancer factor 2D
  ENST ID: ENST00000368240
  CDS Start-End: 407-826
ggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatggggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgt

SEQ ID NO: 156624 - DNA, 5598 bp, Homo sapiens
  Payload ID: 10702
  Gene Symbol: MEF2D
  Gene Name: myocyte enhancer factor 2D
  Uniprot ID: Q14814
  ENST ID: ENST00000464356
  CDS Start-End: 139-1680
gaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgaggcgctgcacaagaagcacagggaatgtgagagccctgaggtggacgaggtgtttgccctgaccccccagacggaagagaaatataaaaagatagacgaggagtttgataaaatgatgcagagttatagactggcctcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaccattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgata

SEQ ID NO: 156625 - DNA, 593 bp, Homo sapiens
  Payload ID: 10702
  Gene Symbol: MEF2D
  Gene Name: myocyte enhancer factor 2D
  ENST ID: ENST00000489057
  CDS Start-End: 562-593
ggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggttcgggtcttagggggatggggaaaggggccccctccccctagtgaatcacgctgtcctctcagcagccttccgaggactcctcctgaaaggaaggcactctagaagccaccgaccgggttatcccaggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaat

SEQ ID NO: 156626 - DNA, 1627 bp, Homo sapiens
  Payload ID: 10702
  Gene Symbol: MEF2D
  Gene Name: myocyte enhancer factor 2D
  ENST ID: ENST00000475587
  CDS Start-End: 407-826
ggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaacggctgcgacagccccgagcccgacggggaggactcgctggaacagagccccctgctggaggacaagtaccgacgcgccagcgaggagctcgacgggctcttccggcgctatggggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttgattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctc

SEQ ID NO: 156627 - DNA, 1629 bp, Homo sapiens
  Payload ID: 10703
  Gene Symbol: MDFI
  Gene Name: MyoD family inhibitor
  Uniprot ID: Q99750
  ENST ID: ENST00000230321
  CDS Start-End: 218-958
ggggctggagggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaga

SEQ ID NO: 156628 - DNA, 809 bp, Homo sapiens
  Payload ID: 10703
  Gene Symbol: MDFI
  Gene Name: MyoD family inhibitor
  ENST ID: ENST00000373050
  CDS Start-End: 188-745
gggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccaggccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtgg

SEQ ID NO: 156629 - DNA, 1622 bp, Homo sapiens
  Payload ID: 10703
  Gene Symbol: MDFI
  Gene Name: MyoD family inhibitor
  Uniprot ID: Q99750
  ENST ID: ENST00000373051
  CDS Start-End: 218-958
ctcctggggcactaggacagacccccgcggctagcagcccggcctggggggcggaacactctcttcttgtcccgccccaccttcctccgggccgcaaccaccccagcccatcgctgggacgtggccgcgggtgccgagagcgctgccggcgccgtgggggccatcccggtcctggccccgacggcgccccaggacctgcgatagccgtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtcca

SEQ ID NO: 156630 - DNA, 1183 bp, Homo sapiens
  Payload ID: 10703
  Gene Symbol: MDFI
  Gene Name: MyoD family inhibitor
  ENST ID: ENST00000419164
  CDS Start-End: 490-1183
tccagagctcccggacagcagccggatcccggccggctcctggggcactaggacagacccccgcggctagcagcccggcctggggggcggaacactctcttcttgtcccgccccaccttcctccgggccgcaaccaccccagcccatcgctgggacgtggccgcgggtgccgagagcgctgccggcgccgtgggggccatcccggtcctggccccgacggcgccccaggacctgcgatagccaaacttttgcagagtttggacaggcaaaggaaaacgtgcagcccgcggatctccgggcctcagagagcagggagtcggggagactgaggccccgctccgagagcgcggaggaagcgcgcccagccggcttcctgtgggggctcgggcctcgggcgccccgcggacagacgtgtccggctcctggctgggccaagcccggcgcgggggaggggacccgcagaggggcgactgagaaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggact

SEQ ID NO: 156631 - DNA, 650 bp, Homo sapiens
  Payload ID: 10703
  Gene Symbol: MDFI
  Gene Name: MyoD family inhibitor
  ENST ID: ENST00000435476
  CDS Start-End: 224-650
ggggaaggggcgccaggcgagcacccgggagccagcgggacctgggcaggggcgcccggagcaggcgcgcatggcgggccccgcgcggggatccggctggaagagagcgtagcacggctcgcacgagtgagtggacgtgggaggcgcgcatctgcgggggaatcgccccttgcccgcctccggcgccgcccgctgagccctgttttccgcaggtccggggccgatgtaccaggtgagcggccagcgcccctctggctgcgacgcgccctatggagcccccagcgcagccccgggcccaggccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgct

SEQ ID NO: 156632 - DNA, 353 bp, Homo sapiens
  Payload ID: 10703
  Gene Symbol: MDFI
  Gene Name: MyoD family inhibitor
  ENST ID: ENST00000441667
  CDS Start-End: 60-353
ggagcgaggggggctggagggagagaaggaagaaggaaggggcgaacggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcacccca

SEQ ID NO: 156633 - DNA, 635 bp, Homo sapiens
  Payload ID: 10703
  Gene Symbol: MDFI
  Gene Name: MyoD family inhibitor
  ENST ID: ENST00000446650
  CDS Start-End: 252-635
ccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtgagtggacgtgggaggcgcgcatctgcgggggaatcgccccttgcccgcctccggcgccgcccgctgagccctgttttccgcaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccgg

SEQ ID NO: 156634 - DNA, 703 bp, Homo sapiens
  Payload ID: 10703
  Gene Symbol: MDFI
  Gene Name: MyoD family inhibitor
  ENST ID: ENST00000432027
  CDS Start-End: 64-703
agacggtgaggattgccttcggaggtgggtgaggcccagcgtgcgcgcccaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacc

SEQ ID NO: 156635 - DNA, 4598 bp, Homo sapiens
  Payload ID: 10704
  Gene Symbol: MDFIC
  Gene Name: MyoD family inhibitor domain containing
  ENST ID: ENST00000257724
  CDS Start-End: 264-1331
cccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcccaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgtttgtgttaaaactggagagtgtttaaaaatttccttttggggggaagaaaagcacattgtaagattctcatgaaacaacatggaatttgcactgttaactcattattgtaagtaatctctgaaagcctttttactttaaccaaatctacatggtttaatatgtgaaattttaactactttaactagttttataaatttcttaatatgttacaataacttagggacattttgacaccccccttcccaaatgttaaatgccttctcctttttaccgatatttctgtttcttttaaccgttctcaggagcactttgctccaaatatattatttttcagtgtgtatttaaacgaggcagtttattttgatatgtatctattcatgattgaaaggaagcagtcttggccaggcacggtggcttacacctgtaaccctggcattttgggaggccaaggtgggcagattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaatttttaaaaatgacttctttattttgctttaccgtatgtttatatctaattgacatattgactaatgtttgaaagaattcaaccataagttaaaatctgaaggttatctttatcatgtttcatccctgtctgaagatttcctagtcttcttatgtaaatcacatgactcatgtccgtaaatgaactatgaaagatatcgatcagtttatgatcattgacatgtgatttcaaaacacagtgttcttttaaaaatctataatatgtcaaaatacaagttttttttttttacatcgttttagtaagttaatttcatttatttactttggagctatatttccacttagaaaaactaaggtaattttacaatatatgctgagattaaaaaccaaggtaaaaatgatcaaacatatatgaaattgagtcttagatttaatgaatttcactcgaaaataaatgatcagaagaatt

SEQ ID NO: 156636 - DNA, 4393 bp, Homo sapiens
  Payload ID: 10704
  Gene Symbol: MDFIC
  Gene Name: MyoD family inhibitor domain containing
  Uniprot ID: Q9P1T7
  ENST ID: ENST00000393486
  CDS Start-End: 386-1126
ggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcccaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgtttgtgttaaaactggagagtgtttaaaaatttccttttggggggaagaaaagcacattgtaagattctcatgaaacaacatggaatttgcactgttaactcattattgtaagtaatctctgaaagcctttttactttaaccaaatctacatggtttaatatgtgaaattttaactactttaactagttttataaatttcttaatatgttacaataacttagggacattttgacaccccccttcccaaatgttaaatgccttctcctttttaccgatatttctgtttcttttaaccgttctcaggagcactttgctccaaatatattatttttcagtgtgtatttaaacgaggcagtttattttgatatgtatctattcatgattgaaaggaagcagtcttggccaggcacggtggcttacacctgtaaccctggcattttgggaggccaaggtgggcagattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaatttttaaaaatgacttctttattttgctttaccgtatgtttatatctaattgacatattgactaatgtttgaaagaattcaaccataagttaaaatctgaaggttatctttatcatgtttcatccctgtctgaagatttcctagtcttcttatgtaaatcacatgactcatgtccgtaaatgaactatgaaagatatcgatcagtttatgatcattgacatgtgatttcaaaacacagtgttcttttaaaaatctataatatgtcaaaatacaagttttttttttttacatcgttttagtaagttaatttcatttatttactttggagctatatttccacttagaaaaactaaggtaattttacaatatatgctgagattaaaaaccaaggtaaaaatgatcaaacatatatgaaattgagtcttagatttaatgaatttcactcgaaaataaatgatcagaagaatt

SEQ ID NO: 156637 - DNA, 647 bp, Homo sapiens
  Payload ID: 10704
  Gene Symbol: MDFIC
  Gene Name: MyoD family inhibitor domain containing
  ENST ID: ENST00000427207
  CDS Start-End: 1-471
ccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcccaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagacaaacaggaattttggtaaaatgcagattaactttcccaaaggaaagcacaagatagaaaaggaagcagtggcagctgacatcctgcttttagataatcgtcttctagagtgaatagtcattactttaaatataactgctatacttctttttttaatgccacatttaaaaatataaatacaacattttgatggca

SEQ ID NO: 156638 - DNA, 474 bp, Homo sapiens
  Payload ID: 10704
  Gene Symbol: MDFIC
  Gene Name: MyoD family inhibitor domain containing
  ENST ID: ENST00000423503
  CDS Start-End: 181-312
gaacgtcccgcaggggtggtgtgctcttctctaaaaacatttttttttttaattttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtctcttcagcagatccaggactgccgcagctctctgaacaagcgtgcacttactccatttcatctttctgtttcttgttggctcctctaccacccggttgataattcaggtttctgtgaccagtagctttggaatggcttatgcttgttttcaataactggtttgttttgaaataaataaacaaggtttataagaaaca

SEQ ID NO: 156639 - DNA, 484 bp, Homo sapiens
  Payload ID: 10704
  Gene Symbol: MDFIC
  Gene Name: MyoD family inhibitor domain containing
  ENST ID: ENST00000448022
  CDS Start-End: 184-315
ctcgctaactttccggggcggaagaggaggaggaggaggaggaaggggcttggagcgactacggggggatgcggagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtctcttcagcagatccaggactgccgcagctctctgaacaagcgtgcacttactccatttcatctttctgtttcttgttggctcctctaccacccggttgataattcaggtttctgtgaccagtagctttggaatggcttatgcttgttttcaataactggtttgttttgaaataaataaacaaggtttataagaaacactttcca

SEQ ID NO: 156640 - DNA, 808 bp, Homo sapiens
  Payload ID: 10704
  Gene Symbol: MDFIC
  Gene Name: MyoD family inhibitor domain containing
  ENST ID: ENST00000431629
  CDS Start-End: 1-471
gggcccgtggggccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcccaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagtttgctgacactccatcgaaggcacttaattttaatgccaaatacagaaacacaaaggacatgtgacaatgattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgtttgtgttaaaa

SEQ ID NO: 156641 - DNA, 584 bp, Homo sapiens
  Payload ID: 10704
  Gene Symbol: MDFIC
  Gene Name: MyoD family inhibitor domain containing
  ENST ID: ENST00000498196
  CDS Start-End: 179-584
agtgaaaattttagggaagtagattttagccaaatgtgaggatggtccgaataattaaaactctgaaagtggaataagctattttctgaggctgtttctctatccctgaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcccaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagattgttgtgtccactgtatcctggcttgcttgttctgcgaattcctgaccctttgcaacattgtcctgggacaagcgt

SEQ ID NO: 156642 - DNA, 5312 bp, Homo sapiens
  Payload ID: 10704
  Gene Symbol: MDFIC
  Gene Name: MyoD family inhibitor domain containing
  ENST ID: ENST00000614186
  CDS Start-End: 264-1331
cccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcccaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgtttgtgttaaaactggagagtgtttaaaaatttccttttggggggaagaaaagcacattgtaagattctcatgaaacaacatggaatttgcactgttaactcattattgtaagtaatctctgaaagcctttttactttaaccaaatctacatggtttaatatgtgaaattttaactactttaactagttttataaatttcttaatatgttacaataacttagggacattttgacaccccccttcccaaatgttaaatgccttctcctttttaccgatatttctgtttcttttaaccgttctcaggagcactttgctccaaatatattatttttcagtgtgtatttaaacgaggcagtttattttgatatgtatctattcatgattgaaaggaagcagtcttggccaggcacggtggcttacacctgtaaccctggcattttgggaggccaaggtgggcagattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaatttttaaaaatgacttctttattttgctttaccgtatgtttatatctaattgacatattgactaatgtttgaaagaattcaaccataagttaaaatctgaaggttatctttatcatgtttcatccctgtctgaagatttcctagtcttcttatgtaaatcacatgactcatgtccgtaaatgaactatgaaagatatcgatcagtttatgatcattgacatgtgatttcaaaacacagtgttcttttaaaaatctataatatgtcaaaatacaagttttttttttttacatcgttttagtaagttaatttcatttatttactttggagctatatttccacttagaaaaactaaggtaattttacaatatatgctgagattaaaaaccaaggtaaaaatgatcaaacatatatgaaattgagtcttagatttaatgaatttcactcgaaaataaatgatcagaagaattttcatctaaggcatagagtggcgaaatttttgtaaatgctcgcagttagcatctaactaaaacaatacagtatgactttatttaggagaaggctttttatttagaaaattattttttcatttttacagtgtatcaactgtatccattttcctcacctggatagtcaatgttatctgagcagttcaaggagtaaccaaggcaaccttatgtaataactttccattctttatccatacaaactctttcagtgccctagattctaatgttataaacgtcaaacatcactgcccaacataaataagactcgagacttattaacataaataagtatcttgccttcttgaatgctagttaaatgcttagatttacctaactgcctaatgaatcaggttatttgttaataagattatttttcaaattatttaagacctttatgccccttccaattacttgtgatttgtaggcctgtaggattgttgcatctaatctgactggcaacagaaaatgtcatcaaatactataatatccattttgttttcttttgcactaatacaacagaacatatcatttttgttttaaacaatggttaatatattaatagggtttgttccacacttactatttatagtttttataatcaagcattgggtattaaaagagaatcctttcaacccttcatcttcgtatgcttatacaataaattgcagtgagtgt

SEQ ID NO: 156643 - DNA, 6680 bp, Homo sapiens
  Payload ID: 10705
  Gene Symbol: MYOF
  Gene Name: myoferlin
  Uniprot ID: Q9NZM1
  ENST ID: ENST00000358334
  CDS Start-End: 1-6147
atgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 156644 - DNA, 6719 bp, Homo sapiens
  Payload ID: 10705
  Gene Symbol: MYOF
  Gene Name: myoferlin
  Uniprot ID: Q9NZM1
  ENST ID: ENST00000359263
  CDS Start-End: 1-6186
atgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 156645 - DNA, 763 bp, Homo sapiens
  Payload ID: 10705
  Gene Symbol: MYOF
  Gene Name: myoferlin
  Uniprot ID: Q9NZM1
  ENST ID: ENST00000371488
  CDS Start-End: 1-483
atgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggtaagctgacccttctgaaggcccagccacccccagggggaggctgctaaagacacacaggagagtgtctggagaaaccctgccattgatcacaagcctgtagctccctgcccacccagacaggggccccgagaggcaggtggggctgcctgaattgggacattgcaattgtttatgaaatgcccttcaaggtagaggggaagggtgaaccaaccctttactgaacaacctcacggtgagcacaaaaagcacatgccggctccagcagaatgtcccagggctttgcttcaggtttgtggcttccaccccatacagtgtctccaggctgtt

SEQ ID NO: 156646 - DNA, 1519 bp, Homo sapiens
  Payload ID: 10705
  Gene Symbol: MYOF
  Gene Name: myoferlin
  Uniprot ID: Q9NZM1
  ENST ID: ENST00000371489
  CDS Start-End: 124-1461
gccctgggagaaatcctcccttcactgggagagaacttctctcccagggcggtgcgacccggagctccagcgccctagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactggtgagttgaaaatacgtatgtgtctaattcaacataaaataaacattggatattgtgaaaca

SEQ ID NO: 156647 - DNA, 4812 bp, Homo sapiens
  Payload ID: 10705
  Gene Symbol: MYOF
  Gene Name: myoferlin
  ENST ID: ENST00000463743
  CDS Start-End: 1-3533
gcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagtgcttaagcagtatgtcaacagcactcagcaaaatggcttctccagcgacagtgcatctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttta

SEQ ID NO: 156648 - DNA, 1801 bp, Homo sapiens
  Payload ID: 10706
  Gene Symbol: MYOD1
  Gene Name: myogenic differentiation 1
  Uniprot ID: P15172
  ENST ID: ENST00000250003
  CDS Start-End: 216-1178
gctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttata

SEQ ID NO: 156649 - DNA, 1542 bp, Homo sapiens
  Payload ID: 10707
  Gene Symbol: MYF5
  Gene Name: myogenic factor 5
  Uniprot ID: P13349
  ENST ID: ENST00000228644
  CDS Start-End: 153-920
acccaggccaacaggcgtctgcccttgttaattaccggagcgacagactagggagctccgcccgggatttgcccatcggcggaggcgccaggctcccgtttctccccatccctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatgcccgaatgtaacagtcctgtctggtccagaaagagcagtacttttgacagcatctactgtcctgatgtatcaaatgtatatgccacagataaaaactccttatccagcttggattgcttatccaacatagtggaccggatcacctcctcagagcaacctgggttgcctctccaggatctggcttctctctctccagttgccagcaccgattcacagcctgcaactccaggggcttctagttccaggcttatctatcatgtgctatgaactaattttctggtctatatgacttcttccaggagggcctaatacacaggaagaagaaggcttcaaaaagtcccaaaccaagacaacatgtacataaagatttcttttcagttgtaaatttgtaaagattaccttgccactttataagaaagtgtatttaactaaaaagtcatcattgcaaataatactttcttcttctttattattctttgcttagatattaatacatagttccagtaatactatttctgatagggggccattgattgagggtagcttgttgcaatgcttaacttatatatacatatatatatattataaatattgctcatcaaaatgtctctggtgtttagagctttatttttttctttaaaacattaaaacagctgagaatcagttaaatggaattttaaatatatttaactatttcttttctctttaatcctttagttatattgtattaaataaaaatataatactgcctaatgtatatattttgatcttttcttgtaagaaatgtatcttttaaatgtaagcacaaaatagtactttgtggatcatttcaagatataagaaattttggaaattccaccataaataaaattttttactacaagaaata

SEQ ID NO: 156650 - DNA, 1465 bp, Homo sapiens
  Payload ID: 10708
  Gene Symbol: MYF6
  Gene Name: myogenic factor 6 (herculin)
  Uniprot ID: P23409
  ENST ID: ENST00000228641
  CDS Start-End: 223-951
agttttctttcaaactagatgttctagagagcactagctgcaatcacattgggagactgatgctccatgacagctaaaagttggattgagtttcaggagctactatatataaagctgggtcgacttatgtcactgcactaattaaatgccatctgggtggttcctctgggtttttgagtccatcacccagttcagatcgagtcagaggccaaggaggagaacatgatgatggacctttttgaaactggctcctatttcttctacttggatggggaaaatgttactctgcagccattagaagtggcagaaggctctcctttgtatccagggagtgatggtaccttgtccccctgccaggaccaaatgcccccggaagcggggagcgacagcagcggagaggaacatgtcctggcgcccccgggcctgcagcctccacactgccccggccagtgtctgatctgggcttgcaagacctgcaagagaaaatctgcccccactgaccggcgaaaagccgccaccctgcgcgaaaggaggaggctaaagaaaatcaacgaggccttcgaggcactgaagcggcgaactgtggccaaccccaaccagaggctgcccaaggtggagattctgcggagcgccatcagctatattgagcggctgcaggacctgctgcaccggctggatcagcaggagaagatgcaggagctgggggtggaccccttcagctacagacccaaacaagaaaatcttgagggtgcggatttcctgcgcacctgcagctcccagtggccaagtgtttccgatcattccagggggctcgtgataacggctaaggaaggaggagcaagtattgattcgtcagcctcgagtagccttcgatgcctttcttccatcgtggacagtatttcctcggaggaacgcaaactcccctgcgtggaggaagtggtggagaagtaactgagcctgcgcttgagaccttctccacgcagcaggaagatcccaccgacccttcctggcctaatcctttagattaggtcacattacattaacatttaggaacccagaccgaaaagttgctgaaagggaaggagacacattcacaaagaaacgttgcgaaaattgcgaaatctgttgtgcatgctcaaatgaaaacgcctttcggctttgggcttttatttttttggaactgcgagtggcttaggtctagcctcattttgtttttgtttggttggttttatactatattaacttttattacggtgatccttttgtgccatgttcaaaagaagttcattcctgtctaaagtgggaaagttgcatttaatgttaggggtatttaatgtatttttgtaaatagtttaacactttctttttttacgtaaacctgaaatatattttaaatgtggaatgatgtatataaaatgtgcgaggatcctggtattgtaatattaaaaagaagtttctatatgaa

SEQ ID NO: 156651 - DNA, 1528 bp, Homo sapiens
  Payload ID: 10709
  Gene Symbol: MYOG
  Gene Name: myogenin (myogenic factor 4)
  Uniprot ID: P15173
  ENST ID: ENST00000241651
  CDS Start-End: 76-750
atggcacccagcagttggcgtgaggggctgctggagcttgggggctggtggcaggaacaagccttttccgaccccatggagctgtatgagacatccccctacttctaccaggaaccccgcttctatgatggggaaaactacctgcctgtccacctccagggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtgcccagcgaatgcagctctcacagcgcctcctgcagtccagagtggggcagtgcactggagttcagcgccaacccaggggatcatctgctcacggctgaccctacagatgcccacaacctgcactccctcacctccatcgtggacagcatcacagtggaagatgtgtctgtggccttcccagatgaaaccatgcccaactgagattgtcttccaagccgggcatccttgcgagccccccaagctggccacagatgccactacttctgtagcaggggcctcctaagccaggctgccctgatgctaggaagccagctctggggtgccataggccagactatccccttcctcatccatgtaaggttaacccaccccccagcaagggactggacgccctcattcagctgcctccttagaggagagggcatcccctttccagggaggtaaagcaggggaccagagcgccccctcgtgtatgccccagctcagggggcaaactcaggagcttcctttttatcataacgcggcctctaattccaccccccaagtgaaacggtttgagagacgcagtgccctgacctggacaagctgtgcacgtctcctgttctggtctcttcccgatgccagtggctgggctgggcctgccctgaattgagagagaagaaggggagaggaacagccctctgttcccaagtccctggggggccaaacttttgcagtgaatattgggaaccttccagtggttttatgttttgttttgtttcgtgtgttgtttgtaaagctgccatccgaccaaggtctcctgtgctgaagttgccggggacaggcagggaaaaggggttggggcctcttgggggtgatttcttttgttaacaaagcattgtgtggttttgccattgttttgtattttttttttttttttttttttttgctaacttatttggatttccttttttaaaaaatgaataaagactggttgcca

SEQ ID NO: 156652 - DNA, 1170 bp, Homo sapiens
  Payload ID: 10710
  Gene Symbol: MB
  Gene Name: myoglobin
  Uniprot ID: P02144
  ENST ID: ENST00000359787
  CDS Start-End: 173-637
gagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctca

SEQ ID NO: 156653 - DNA, 1197 bp, Homo sapiens
  Payload ID: 10710
  Gene Symbol: MB
  Gene Name: myoglobin
  Uniprot ID: P02144
  ENST ID: ENST00000397326
  CDS Start-End: 200-664
gattagaccctccctggatgagagagagaaagtgaaggagggcaggggagggggacagcgagccattgagcgatctttgtcaagcatcccagaaggtataaaaacgcccttgggaccaggcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctca

SEQ ID NO: 156654 - DNA, 1153 bp, Homo sapiens
  Payload ID: 10710
  Gene Symbol: MB
  Gene Name: myoglobin
  Uniprot ID: P02144
  ENST ID: ENST00000397328
  CDS Start-End: 156-620
aatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctca

SEQ ID NO: 156655 - DNA, 582 bp, Homo sapiens
  Payload ID: 10710
  Gene Symbol: MB
  Gene Name: myoglobin
  Uniprot ID: P02144
  ENST ID: ENST00000406324
  CDS Start-End: 93-557
gctataagacacctctccccacccccagccctggccgcttggctggaggctctgcgaggacagctggggagaaggggagctgtgactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccaccc

SEQ ID NO: 156656 - DNA, 1043 bp, Homo sapiens
  Payload ID: 10710
  Gene Symbol: MB
  Gene Name: myoglobin
  ENST ID: ENST00000401702
  CDS Start-End: 211-510
gccttatttctctgctggttgagcgaagggattgtcttccatggtctccgagatcccgtcccacgctcatgccctagaattctctgagtccttgatgcacttttgcctttggcgaggaggcaggacagtcaggcgtggaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctca

SEQ ID NO: 156657 - DNA, 515 bp, Homo sapiens
  Payload ID: 10710
  Gene Symbol: MB
  Gene Name: myoglobin
  ENST ID: ENST00000447607
  CDS Start-End: 198-515
gagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 156658 - DNA, 551 bp, Homo sapiens
  Payload ID: 10710
  Gene Symbol: MB
  Gene Name: myoglobin
  ENST ID: ENST00000451685
  CDS Start-End: 234-551
agtgcccaacctcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 156659 - DNA, 648 bp, Homo sapiens
  Payload ID: 10710
  Gene Symbol: MB
  Gene Name: myoglobin
  ENST ID: ENST00000443033
  CDS Start-End: 220-648
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatg

SEQ ID NO: 156660 - DNA, 545 bp, Homo sapiens
  Payload ID: 10710
  Gene Symbol: MB
  Gene Name: myoglobin
  ENST ID: ENST00000442617
  CDS Start-End: 324-545
aaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggtaaaaggaagagattccattgcccctgccacccacaccctaagatcaagggtgttcagctgcaaggtggaaagtttgcacgtggggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccag

SEQ ID NO: 156661 - DNA, 418 bp, Homo sapiens
  Payload ID: 10710
  Gene Symbol: MB
  Gene Name: myoglobin
  ENST ID: ENST00000419229
  CDS Start-End: 187-418
cttggctggaggctctgcgaggacagctggggagaaggggagctgtgcccagatttaccaaagggaattgtcagctgtccaagggctagcaaattcctaggtcacctagattggattttctgaccataaaaactgtgggccaggtgcacagctgcctgaggggctcaaacctgtgcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatcctta

SEQ ID NO: 156662 - DNA, 1130 bp, Homo sapiens
  Payload ID: 10711
  Gene Symbol: MIOX
  Gene Name: myo-inositol oxygenase
  Uniprot ID: Q9UGB7
  ENST ID: ENST00000216075
  CDS Start-End: 75-932
gtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtgcttctgaagcc

SEQ ID NO: 156663 - DNA, 1658 bp, Homo sapiens
  Payload ID: 10711
  Gene Symbol: MIOX
  Gene Name: myo-inositol oxygenase
  ENST ID: ENST00000395732
  CDS Start-End: 23-835
ctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctggcaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtgcttctgaagccccactgggtgttactgcagcagggcgtggcccaggccgagggatggtgccagcagggtggaggccaagtcccaggctttcaggtgtgtgtgtcccaccacactggccgtggtaaacatctgcccatcctcccagctcctgtgtcagagcctgggggacgagtcacccagctcacccccacatgctcaaaacagtcaccaagtcctctgggctccgtccccttaaaaaataccccaatagctaaaataatacattcatagaaaacaacaaaaaacaaatgcaggctgggcacagcggctcacacctataatcccagcactttgggagggcgaggtgggcggatcacctgaggtcaggggttcaagaccagcctggccaacatggtgaaaccccgtctctactaaaaatacaaaaattagccgggcgtggtggtgggcgcctgtaatcccagctattcaggaggctaaggcaggagaatcgcttgaacccgggagacaggggttgccgtgagtcaagattgtgccactgcactccaacctgggtatcaagagtgaaattccatctcaaaaaaaataaataaaataaaataaaacaa

SEQ ID NO: 156664 - DNA, 1021 bp, Homo sapiens
  Payload ID: 10711
  Gene Symbol: MIOX
  Gene Name: myo-inositol oxygenase
  Uniprot ID: Q9UGB7
  ENST ID: ENST00000395733
  CDS Start-End: 115-810
ggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggtccccaacctgccctgtccatccccctcccagactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgcaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaagga

SEQ ID NO: 156665 - DNA, 918 bp, Homo sapiens
  Payload ID: 10711
  Gene Symbol: MIOX
  Gene Name: myo-inositol oxygenase
  ENST ID: ENST00000451761
  CDS Start-End: 1-798
ggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcaccc

SEQ ID NO: 156666 - DNA, 5154 bp, Homo sapiens
  Payload ID: 10712
  Gene Symbol: MYOM1
  Gene Name: myomesin 1
  Uniprot ID: P52179
  ENST ID: ENST00000261606
  CDS Start-End: 76-4845
tcggcctcatcggaacatttccaccaccattactcctttggaaactggtggcccggttccttcaaggggcacaggatgtctttgcctttttatcagaggtgccaccagcactatgatctcagctaccgcaacaaggacgtgcgcagcaccgtgagtcactaccagcgggagaagaaacgctccgccgtctacacccagggctccacggcctacagcagccgctcctccgccgcgcaccgccgggagtccgaggccttccgtcgggcgtccgcctcctcctcccagcagcaggcctcgcagcacgccctgagctctgaagtcagtcggaaggcagcctcagcctacgattatggctcctcccatggacttacagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaagaagctgctgcttatatagcccagaggaatcttcttgctagtgaggaaggaatcacaacatctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgagaaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggctggccagaacctcgtgtcacgtggtataaaaaccaggtgccaataaatgtccatgcaaaccctggaaagtatattattgagagtcgatatgggatgcacactctggagattaatggatgtgattttgaagatacagctcagtaccgggcctcggcgatgaatgttaaaggagagctttcggcatatgcttcagttgtggtaaaaaggtataagggagagtttgatgagactcgcttccacgctggggcttccaccatgcccctcagctttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccagtggtacagaaacggagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgagatgctgatgcagagattgaaggagccccagctgctcccttggatgtgaagtgcttggaggccaacaaagattatatcatcatctcctggaaacagccagctgtcgatggagggagtcctattctcggatattttattgataagtgtgaggtgggcacagatagctggtcgcagtgcaatgacacacctgtgaagtttgctcgttttcctgtcactggattgatcgaaggtcgttcctatatcttccgagttcgagctgtgaataaaatgggaataggtttcccatctcgagtttccgagcccgtggctgctctggatccggctgagaaagctagacttaaaagtcgcccctcagcaccctggactggacagatcattgttactgaagaggaaccttcagagggtattgtgcctggccccccgacagacctctctgtcactgaggccacccggagctatgtggtgctcagctggaagccccctggccagcgtggtcatgagggcattatgtactttgtggaaaagtgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttgatatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaagggctcacgattcacttgtcatggattagtgactggtcagagttatattttccgggtcagagcagtcaatgcagctggacttagtgaatattcccaggattcagaagctattgaagtcaaagctgctattgcaccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaagcatacgatgaggcctatgctgaattccagaggttgaaacaagctgccattgccgagaaaaatcgtgcccgggtgttgggaggtctcccagacgtggtcaccatccaggaggggaaggcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtg

SEQ ID NO: 156667 - DNA, 5847 bp, Homo sapiens
  Payload ID: 10712
  Gene Symbol: MYOM1
  Gene Name: myomesin 1
  Uniprot ID: P52179
  ENST ID: ENST00000356443
  CDS Start-End: 335-5392
ggcattatgcaattatattactaaggctgctacctgcccatgcccctctcctcctcctggtttggaactaccctccccatctgctgctatatttatctgccttcttggccataaaaggctggttgtgtggcctgacattcgactgcctgaccacatgcattatttttgaactggcccccagggtcctgtctttagccctgcctcttaacattgtcttggattcaacctaggtggagtcttcattctctcatccagctcctcggcctcatcggaacatttccaccaccattactcctttggaaactggtggcccggttccttcaaggggcacaggatgtctttgcctttttatcagaggtgccaccagcactatgatctcagctaccgcaacaaggacgtgcgcagcaccgtgagtcactaccagcgggagaagaaacgctccgccgtctacacccagggctccacggcctacagcagccgctcctccgccgcgcaccgccgggagtccgaggccttccgtcgggcgtccgcctcctcctcccagcagcaggcctcgcagcacgccctgagctctgaagtcagtcggaaggcagcctcagcctacgattatggctcctcccatggacttacagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaagaagctgctgcttatatagcccagaggaatcttcttgctagtgaggaaggaatcacaacatctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgagaaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggctggccagaacctcgtgtcacgtggtataaaaaccaggtgccaataaatgtccatgcaaaccctggaaagtatattattgagagtcgatatgggatgcacactctggagattaatggatgtgattttgaagatacagctcagtaccgggcctcggcgatgaatgttaaaggagagctttcggcatatgcttcagttgtggtaaaaaggtataagggagagtttgatgagactcgcttccacgctggggcttccaccatgcccctcagctttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccagtggtacagaaacggagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgagatgctgatgcagagattgaaggagccccagctgctcccttggatgtgaagtgcttggaggccaacaaagattatatcatcatctcctggaaacagccagctgtcgatggagggagtcctattctcggatattttattgataagtgtgaggtgggcacagatagctggtcgcagtgcaatgacacacctgtgaagtttgctcgttttcctgtcactggattgatcgaaggtcgttcctatatcttccgagttcgagctgtgaataaaatgggaataggtttcccatctcgagtttccgagcccgtggctgctctggatccggctgagaaagctagacttaaaagtcgcccctcagcaccctggactggacagatcattgttactgaagaggaaccttcagagggtattgtgcctggccccccgacagacctctctgtcactgaggccacccggagctatgtggtgctcagctggaagccccctggccagcgtggtcatgagggcattatgtactttgtggaaaagtgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttgatatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaagggctcacgattcacttgtcatggattagtgactggtcagagttatattttccgggtcagagcagtcaatgcagctggacttagtgaatattcccaggattcagaagctattgaagtcaaagctgctattgggggaggagtgtctccagatgtgtgtcccgcactgagcgatgagcctggtggactaaccgcctccagggggcgcgtgcatgaagcctccccgccaaccttccagaaagatgctttgcttggcagcaaacctaacaaaccttcactacccagtagctctcaaaacctgggccaaacagaagtgagtaaagtaagtgaaacagttcaggaagagcttaccccgccaccacagaaagcggctcctcaggggaaaagtaagtctgaccccctgaaaaagaagacagacagagcaccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaagcatacgatgaggcctatgctgaattccagaggttgaaacaagctgccattgccgagaaaaatcgtgcccgggtgttgggaggtctcccagacgtggtcaccatccaggaggggaaggcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgaattgggatttgctgcagctgtgaagccatggccgtgtctcgtgtgttgttacagaggtgatgtgcttttcgacgggcgcctcgtggcttggaacctcctctgtatgaataaacagttttcacgtctgtcctcttccccga

SEQ ID NO: 156668 - DNA, 4927 bp, Homo sapiens
  Payload ID: 10712
  Gene Symbol: MYOM1
  Gene Name: myomesin 1
  ENST ID: ENST00000400569
  CDS Start-End: 115-4473
acagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaagaagctgctgcttatatagcccagaggaatcttcttgctagtgaggaaggaatcacaacatctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgagaaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggctggccagaacctcgtgtcacgtggtataaaaaccaggtgccaataaatgtccatgcaaaccctggaaagtatattattgagagtcgatatgggatgcacactctggagattaatggatgtgattttgaagatacagctcagtaccgggcctcggcgatgaatgttaaaggagagctttcggcatatgcttcagttgtggtaaaaaggtataagggagagtttgatgagactcgcttccacgctggggcttccaccatgcccctcagctttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccagtggtacagaaacggagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgagatgctgatgcagagattgaaggagccccagctgctcccttggatgtgaagtgcttggaggccaacaaagattatatcatcatctcctggaaacagccagctgtcgatggagggagtcctattctcggatattttattgataagtgtgaggtgggcacagatagctggtcgcagtgcaatgacacacctgtgaagtttgctcgttttcctgtcactggattgatcgaaggtcgttcctatatcttccgagttcgagctgtgaataaaatgggaataggtttcccatctcgagtttccgagcccgtggctgctctggatccggctgagaaagctagacttaagtcgcccctcagcaccctggactggacaatcattgttactgaagaggaaccttcagagggtattgtgcctggccccccgacagacctctctgtcactgaggccacccggagctatgtggtgctcagctggaagccccctggccagcgtggtcatgagggcattatgtactttgtggaaaagtgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttgatatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaaggctcacggattcacttgtcatggattagtgactggtcagagttatattttccgggtcagagcagtcaatgcagctggacttagtgaatattcccaggattcagaagctattgaagtcaaagctgctattgcaccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaagcatacgatgaggcctatgctgaattccagaggttgaaacaagctgccattgccgagaaaaatcgtgcccgggtgttgggaggtctcccagacgtggtcaccatccaggaggggaaggcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgaattgggatttgctgcagctgtgaagccatggccgtgtctcgtgtgttgttacagaggtgatgtgcttttcgacgggcgcctcgtggcttggaacctcctctgtatgaataaacagttttcacgtctgtcctcttccccg

SEQ ID NO: 156669 - DNA, 684 bp, Homo sapiens
  Payload ID: 10712
  Gene Symbol: MYOM1
  Gene Name: myomesin 1
  ENST ID: ENST00000581075
  CDS Start-End: 1-366
atcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaagcatacgatgaggcctatgctgaat

SEQ ID NO: 156670 - DNA, 5014 bp, Homo sapiens
  Payload ID: 10713
  Gene Symbol: MYOM2
  Gene Name: myomesin 2
  Uniprot ID: P54296
  ENST ID: ENST00000262113
  CDS Start-End: 142-4539
aacgggagggaggcacaggcgcttgctttgcaggagtcagctctgccttcctcggctggagtgtgggtggcttggtgagccggtggtcaggaattctctctcctccttgcaattttcctttctgtctgggagcacgccaagatgtcccttgtgactgtccccttctaccagaagagacataggcacttcgaccagtcctaccgtaatattcaaacacggtacctgctggacgaatatgcgtcaaaaaagcgagcttccacccaggcatcttcccagaagtccttgagtcagcggtcgtcttcacagagagcctccagccagacgtccctgggaggaaccatctgcagggtctgtgcgaagcgagtgagcacgcaggaagatgaggagcaggagaacagaagcaggtaccagtccctggtggccgcctatggtgaggccaagcgacagcgcttcctcagcgagctggcccacttggaggaggatgtccacctggcacgctcccaggcccgcgacaagctggacaaatacgccattcagcagatgatggaggacaagctggcctgggagagacacacatttgaagagcggataagcagggctcctgagatcctggtgcggctgcgatcccacaccgtctgggagaggatgtctgtgaaactctgcttcaccgtgcaaggatttcccacgcccgtggtgcagtggtacaaagatggcagtctgatttgccaggcggctgaaccgggaaagtacaggattgagagcaactatggcgtacacacactggagatcaacagggcagactttgacgacactgcgacatactcagcagtggccaccaatgcccacggacaagtgtccaccaacgcggcggtggtggtgagaaggttccggggagacgaggaaccattccgttcggtgggactcccgattggattgcccctgtcatcgatgattccgtacacgcacttcgacgtccagtttttggagaagtttggggtcaccttcaggagggaaggcgagacggtcactctcaagtgcaccatgctggtgacgccggacctgaagcgggtgcagccgcgcgccgagtggtaccgcgatgacgtgctgttgaaagagtccaagtggacgaagatgttctttggagaaggccaggcctccctgtccttcagccacctgcacaaggacgacgagggcctgtacaccctgcgcatcgtgtctcggggcggcgtcagcgaccacagcgccttcctgtttgtcagagatgctgacccgctggtcacaggggcccccggtgcacccatggacttgcagtgccacgacgccaaccgggactacgtcatcgtgacctggaagccgcccaacaccaccactgagagccccgtcatgggctattttgtggaccgatgtgaagtaggaacgaataattgggtgcagtgcaatgatgcaccggtgaaaatctgcaaatacccggtcacagggctttttgaaggaaggtcttacatattccgagtgagggcagtgaacagtgcgggcatcagccgaccctccagggtctctgatgcggtggctgcacttgaccccttggacctcagaaggttacaagccgttcatttggagggagagaaggagattgccatttatcaggatgaccttgaaggtgacgcccaggttccagggcctcccaccggtgtgcacgcttccgagatcagcagaaactatgtcgtcctcagctgggagccacccactccccgtggcaaggacccgctcatgtacttcattgagaagtccgtggtggggagcggcagctggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccgttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccatcggatacaacaggttcgtggtgcacggcttaaccacgggagagcagtacatcttccgagtcaaggcggtcaatgctgtggggatgagtgaaaattcccaggaatcagacgtcataaaagtgcaggccgcactcaccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacggtggacggcttgacggaaggctcactctacgagttcaaaatcgccgccgtcaacctggccggcatcggggagccctcagatcccagtgagcacttcaagtgtgaggcctggaccatgccggagcccggtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtcaatcagacgacaacagccagccgttatttaaaggtctctgacctgcagcaaggtaagacctatgtcttcagggtccgggcagtcaatgcaaatggcgtggggaagccctcagacacgtcggagcctgtgctggtagaggcgagaccaggcaccaaggaaatcagtgctggtgtcgatgaacaaggcaacatctatctgggcttcgactgccaggaaatgacagacgcgtctcagttcacctggtgtaaatcctacgaggagatttcagatgatgagaggtttaaaattgaaaccgtgggggatcactccaagctgtacttaaagaatccggataaggaggatttagggacttactccgtgtctgtaagtgatacagacggagtgtcctccagttttgttctggacccagaagagctcgagcgtttgatggcattgagcaatgaaataaagaaccccacaattcctctgaaatcggaattagcttatgagatttttgataaggggcgggttcgcttctggctccaggctgagcacttatcaccagatgccagctaccgatttattattaacgacagagaagtctctgacagcgagatacacagaattaaatgtgacaaagctactggcattattgagatggtgatggatcgatttagtattgaaaatgaggggacctacactgtgcagattcatgatgggaaagccaaaagtcagtcttctctagttcttattggagatgcattcaagactgtgctggaagaggctgagtttcaaaggaaagaatttctcaggaaacaaggccctcattttgctgagtacttgcactgggatgtcacggaagaatgtgaagttcgacttgtttgcaaggttgcaaacaccaagaaagaaaccgttttcaaatggctcaaggatgatgttctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagaattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 156671 - DNA, 3328 bp, Homo sapiens
  Payload ID: 10713
  Gene Symbol: MYOM2
  Gene Name: myomesin 2
  ENST ID: ENST00000523438
  CDS Start-End: 182-2854
gcaggagtcagctctgccttcctcggctggagtgtgggtggcttggtgagccggtggtcaggaattctctctcctccttgcaattttcctttctgtctggtccgtggtggggagcggcagctggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccgttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccatcggatacaacaggttcgtggtgcacggcttaaccacgggagagcagtacatcttccgagtcaaggcggtcaatgctgtggggatgagtgaaaattcccaggaatcagacgtcataaaagtgcaggccgcactcaccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacggtggacggcttgacggaaggctcactctacgagttcaaaatcgccgccgtcaacctggccggcatcggggagccctcagatcccagtgagcacttcaagtgtgaggcctggaccatgccggagcccggtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtcaatcagacgacaacagccagccgttatttaaaggtctctgacctgcagcaaggtaagacctatgtcttcagggtccgggcagtcaatgcaaatggcgtggggaagccctcagacacgtcggagcctgtgctggtagaggcgagaccaggcaccaaggaaatcagtgctggtgtcgatgaacaaggcaacatctatctgggcttcgactgccaggaaatgacagacgcgtctcagttcacctggtgtaaatcctacgaggagatttcagatgatgagaggtttaaaattgaaaccgtgggggatcactccaagctgtacttaaagaatccggataaggaggatttagggacttactccgtgtctgtaagtgatacagacggagtgtcctccagttttgttctggacccagaagagctcgagcgtttgatggcattgagcaatgaaataaagaaccccacaattcctctgaaatcggaattagcttatgagatttttgataaggggcgggttcgcttctggctccaggctgagcacttatcaccagatgccagctaccgatttattattaacgacagagaagtctctgacagcgagatacacagaattaaatgtgacaaagctactggcattattgagatggtgatggatcgatttagtattgaaaatgaggggacctacactgtgcagattcatgatgggaaagccaaaagtcagtcttctctagttcttattggagatgcattcaagactgtgctggaagaggctgagtttcaaaggaaagaatttctcaggaaacaaggccctcattttgctgagtacttgcactgggatgtcacggaagaatgtgaagttcgacttgtttgcaaggttgcaaacaccaagaaagaaaccgttttcaaatggctcaaggatgatgttctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagaattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatc

SEQ ID NO: 156672 - DNA, 5014 bp, Homo sapiens
  Payload ID: 10713
  Gene Symbol: MYOM2
  Gene Name: myomesin 2
  Uniprot ID: P54296
  ENST ID: ENST00000616680
  CDS Start-End: 142-4539
aacgggagggaggcacaggcgcttgctttgcaggagtcagctctgccttcctcggctggagtgtgggtggcttggtgagccggtggtcaggaattctctctcctccttgcaattttcctttctgtctgggagcacgccaagatgtcccttgtgactgtccccttctaccagaagagacataggcacttcgaccagtcctaccgtaatattcaaacacggtacctgctggacgaatatgcgtcaaaaaagcgagcttccacccaggcatcttcccagaagtccttgagtcagcggtcgtcttcacagagagcctccagccagacgtccctgggaggaaccatctgcagggtctgtgcgaagcgagtgagcacgcaggaagatgaggagcaggagaacagaagcaggtaccagtccctggtggccgcctatggtgaggccaagcgacagcgcttcctcagcgagctggcccacttggaggaggatgtccacctggcacgctcccaggcccgcgacaagctggacaaatacgccattcagcagatgatggaggacaagctggcctgggagagacacacatttgaagagcggataagcagggctcctgagatcctggtgcggctgcgatcccacaccgtctgggagaggatgtctgtgaaactctgcttcaccgtgcaaggatttcccacgcccgtggtgcagtggtacaaagatggcagtctgatttgccaggcggctgaaccgggaaagtacaggattgagagcaactatggcgtacacacactggagatcaacagggcagactttgacgacactgcgacatactcagcagtggccaccaatgcccacggacaagtgtccaccaacgcggcggtggtggtgagaaggttccggggagacgaggaaccattccgttcggtgggactcccgattggattgcccctgtcatcgatgattccgtacacgcacttcgacgtccagtttttggagaagtttggggtcaccttcaggagggaaggcgagacggtcactctcaagtgcaccatgctggtgacgccggacctgaagcgggtgcagccgcgcgccgagtggtaccgcgatgacgtgctgttgaaagagtccaagtggacgaagatgttctttggagaaggccaggcctccctgtccttcagccacctgcacaaggacgacgagggcctgtacaccctgcgcatcgtgtctcggggcggcgtcagcgaccacagcgccttcctgtttgtcagagatgctgacccgctggtcacaggggcccccggtgcacccatggacttgcagtgccacgacgccaaccgggactacgtcatcgtgacctggaagccgcccaacaccaccactgagagccccgtcatgggctattttgtggaccgatgtgaagtaggaacgaataattgggtgcagtgcaatgatgcaccggtgaaaatctgcaaatacccggtcacagggctttttgaaggaaggtcttacatattccgagtgagggcagtgaacagtgcgggcatcagccgaccctccagggtctctgatgcggtggctgcacttgaccccttggacctcagaaggttacaagccgttcatttggagggagagaaggagattgccatttatcaggatgaccttgaaggtgacgcccaggttccagggcctcccaccggtgtgcacgcttccgagatcagcagaaactatgtcgtcctcagctgggagccacccactccccgtggcaaggacccgctcatgtacttcattgagaagtcggtggtggggagcggcagctggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccgttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccattggatacaacaggttcgtggtgcacggcttaaccacgggagagcagtacatcttccgagtcaaggcggtcaatgctgtggggatgagtgaaaattcccaggaatcagacgtcataaaagtgcaggccgcactcaccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacggtggacggcttgacggaaggctcactctacgagttcaaaatcgccgccgtcaacctggccggcatcggggagccctcagatcccagtgagcacttcaagtgtgaggcctggaccatgccggagcccggtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtaaatcagacgacaacagccaaccgttatttaaaggtctctgacctgcagcaaggtaagacctatgtcttcagggtccgggcagtcaatgcaaatggcgtggggaagccctcagacacgtcggagcctgtgctggtagaggcgagaccaggcaccaaggaaatcagtgctggtgtcgatgaacaaggcaacatctatctgggcttcgactgccaggaaatgacagacgcgtctcagttcacctggtgtaaatcctacgaggagatttcagatgatgagaggtttaaaatcgaaaccgtgggggatcactccaagctgtacttaaagaatccggataaggaggatttagggacttactccgtgtctgtaagtgatacagacggagtgtcctccagttttgttctggacccagaagagctcgagcgtttgatggcattgagcaatgaaataaagaaccccacaattcctctgaaatcggaattagcttatgagatttttgataaggggcgggttcgcttctggctccaggctgagcacttatcaccagatgccagctaccgatttattattaacgacagagaagtctctgacagcgagatacacagaattaaatgtgacaaagctactggcattattgagatggtgatggatcgatttagtattgaaaatgaggggacctacactgtgcagattcatgatgggaaagccaaaagtcagtcttctctagttcttattggagatgcattcaagactgtgctggaagaggctgagtttcaaaggaaagaatttctcaggaaacaaggccctcattttgctgagtacttgcactgggatgtcacggaagaatgtgaagttcgacttgtttgcaaggttgcaaacaccaagaaagaaaccgttttcaaatggctcaaggatgatgttctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 156673 - DNA, 3328 bp, Homo sapiens
  Payload ID: 10713
  Gene Symbol: MYOM2
  Gene Name: myomesin 2
  ENST ID: ENST00000633850
  CDS Start-End: 182-2854
gcaggagtcagctctgccttcctcggctggagtgtgggtggcttggtgagccggtggtcaggaattctctctcctccttgcaattttcctttctgtctggtcggtggtggggagcggcagctggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccgttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccattggatacaacaggttcgtggtgcacggcttaaccacgggagagcagtacatcttccgagtcaaggcggtcaatgctgtggggatgagtgaaaattcccaggaatcagacgtcataaaagtgcaggccgcactcaccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacggtggacggcttgacggaaggctcactctacgagttcaaaatcgccgccgtcaacctggccggcatcggggagccctcagatcccagtgagcacttcaagtgtgaggcctggaccatgccggagcccggtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtaaatcagacgacaacagccaaccgttatttaaaggtctctgacctgcagcaaggtaagacctatgtcttcagggtccgggcagtcaatgcaaatggcgtggggaagccctcagacacgtcggagcctgtgctggtagaggcgagaccaggcaccaaggaaatcagtgctggtgtcgatgaacaaggcaacatctatctgggcttcgactgccaggaaatgacagacgcgtctcagttcacctggtgtaaatcctacgaggagatttcagatgatgagaggtttaaaatcgaaaccgtgggggatcactccaagctgtacttaaagaatccggataaggaggatttagggacttactccgtgtctgtaagtgatacagacggagtgtcctccagttttgttctggacccagaagagctcgagcgtttgatggcattgagcaatgaaataaagaaccccacaattcctctgaaatcggaattagcttatgagatttttgataaggggcgggttcgcttctggctccaggctgagcacttatcaccagatgccagctaccgatttattattaacgacagagaagtctctgacagcgagatacacagaattaaatgtgacaaagctactggcattattgagatggtgatggatcgatttagtattgaaaatgaggggacctacactgtgcagattcatgatgggaaagccaaaagtcagtcttctctagttcttattggagatgcattcaagactgtgctggaagaggctgagtttcaaaggaaagaatttctcaggaaacaaggccctcattttgctgagtacttgcactgggatgtcacggaagaatgtgaagttcgacttgtttgcaaggttgcaaacaccaagaaagaaaccgttttcaaatggctcaaggatgatgttctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatc

SEQ ID NO: 156674 - DNA, 2693 bp, Homo sapiens
  Payload ID: 10714
  Gene Symbol: MYOM3
  Gene Name: myomesin 3
  Uniprot ID: Q5VTT5
  ENST ID: ENST00000338909
  CDS Start-End: 372-1364
acacggtaagagggagagcccaggtttgaacaagtctatctgattccaaagcctaaggtccttcttagcactcttcagcctgtttagataactggggaaggggagggtgggtgctctcccagaagcatattcattcagtaaactcagagcatctattttgtgccactctgcacggtactgaacgtacaaagatgatgaagtggtctctgtgggccttgggagcccatgttcaaggcaggaccattggaaaacagcatccctcatgcttgacccggatggggcaggacattgatgaatcgtgatggagggggtgactatgggatgcttcaaaaaaaaggcttcctggaggagatgacatttaactgaagcacatggacatttccaagaaaaatagagtaaggcagggatcaagaggcagagggaaaaccattagcaagaattcagagtccagaggccagcagaggagacacatggtgaccaacaccaagaaggagactcgctttcagtggttcttccagagggcagagatgccagatggtcagtatgacccagagacgggaacgggacttctctgcattgaagagttgtccaaaaaggacaagggaatttacagagcgatggtttctgacgatcgaggggaggacgacaccatattggacctcacgggtgacgccctggatgccatcttcaccgagttgggcaggattggtgccctctctgcaactccactgaaaatccaggggaccgaggaagggatccggatcttcagcaaggtcaagtactacaacgtggagtacatgaaaaccacctggttccacaaagacaaacgtctggagagtggtgatcggataaggacgggcaccaccctggatgagatctggcttcacatcctggaccccaaagactcagacaagggcaaatacactctggaaatagctgcagggaaggaagtccggcagctctcaacagatctctcagggcaagcttttgaggatgcaatggctgaacaccagagactgaaaaccttggccatcatcgagaagaatcgtgccaaagtggtgagaggtctgccggatgtggccactatcatggaagataagaccctgtgcttgacttgcatcgtctcaggagaccccacccctgaaatctcttggctgaagaatgaccagcctgtcaccttccttgaccgataccgcatggaagtgagggggacagaggtcaccatcaccattgagaaggtcaacagtgaagacagcggccgctacggcgtcttcgtcaagaacaagtatggctccgagacgggccaggtcaccatcagtgtgttcaagcacggggacgagcccaaggagctgaagagcatgtgacagcgtgtgtccaggcacagtctgagtctagtctacatggaccagtagggacaacctgtaccagggtcacagcctggcacaggctacaggggtggggcagaaggaaaggggacaagatagaacccaggatgtgagggtgggggtggagcggatgcaccaaagtggagaagcaaagatctttctggggtcctgagtggcttccaggagagcgggatgaaccctggacctggagtaggagacccggatgcactggggctatctaacagtactggcatctgataggtagaggtcaggtacgctgctaaacactgcagctcccaccacatagaattatccgaccccagatgtcaaaagtgccaagggccatgagccctgccataaactgatacatcgcacccctcttttaggatcccatagtttcaattcatgtaagttcaacagacacctgaagtctagcatgtgggaggctgaggatggagctgggaacacaaaggcagctgataagcaggttctgcttgcaaagaggcctcagtccagtgggagaaacagacctgggcgcaaacaactccaggacaaggcaggacatgataaagattataaagcaggtccaaggaaagtgccgccagtggtccaaggagggagacagagggtcgtcccaacagggggaggtagggctttgaaaacaccttcatccaggctgggcgaggtggctcacgcctgtaatcccagtagtttgggaggccaaggcgggcagatcacctgaggtcaggagttttagaccagcctggccaacatgacgaaacccggtctctactaaaaatacaaaaattagccaggcatggtggcaggtgcctgtaatcccggctattcagaaggccgaggtgggagaatccgttgaacctgggaggcggaggttgtgatgagccaagattgagccaaaaaaaaattagcagaattggtgttgggccctgaaaaattagtccgattttgtggtggtaatgggagaaggacatcccaggagcagggtctggtgggaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaacaccacaaagt

SEQ ID NO: 156675 - DNA, 5804 bp, Homo sapiens
  Payload ID: 10714
  Gene Symbol: MYOM3
  Gene Name: myomesin 3
  Uniprot ID: Q5VTT5
  ENST ID: ENST00000374434
  CDS Start-End: 164-4477
agtgctgctatatttaagacggtgcagtctccgggatcgcattcttctcccggtgcccgctgagccgagggcaagaagagaacaaggaccctctcggcctcaggaatcttctccccagagactcctaagtgggcacactgcttctgttgttgctctcgtaaccatgactctgccgcacagcttgggaggtgcgggggacccccggcccccccaggccatggaggttcacaggctggagcaccggcaggaggaggagcagaaggaggagcggcagcacagcctgcgcatgggctcctctgtgcggaggcggaccttccgcagcagcgaagaagagcatgagttcagcgccgcggactacgccctggcagcagccctggctctgacggcctcctccgagctgtcttgggaagcccagctgagacgccagacctctgccgtggagctggaggagcgagggcagaagcgggtgggcttcggcaatgactgggagaggactgagatcgccttcctgcagacccaccggctgctgcgccagaggcgggactggaagacgctgaggcggcggacagaggagaaggtccaggaggccaaggagctgagggagctgtgctacggccgcgggccctggttctggatccctcttcgctcccacgccgtctgggagcacaccacggtcctgctgacctgcactgtccaggcctcaccaccaccccaggtcacctggtacaaaaatgacacacggattgatccccgcctctttcgtgccggaaaataccgaatcaccaacaactacgggctgctgtccctggagattaggagatgcgccattgaggactcagcaacttacactgtgcgagtgaagaacgcccacggccaggcctcctccttcgccaaagtcctcgtccgcacttacctggggaaggatgctggcttcgattcagagatcttcaaaagatcgacgtttggccccagcgtggaattcacctcggtgctgaagccagtctttgctcgtgagaaggaacccttctccctgtcatgcttgttttcggaagatgtgttagatgctgagagcatccagtggttccgagatgggagcctactgaggtcctcgagacgtcggaagatcctctacacagaccgccaggcatccctgaaggtgtcctgcacctacaaggaggacgaggggctctacatggtccgggtgccctcgcccttcggaccccgggaacagagcacctacgtgcttgtgagagatgccgaggccgagaaccccggggccccaggctccccactgaacgtccgatgcctggatgtgaacagagactgcctcatcctgacttgggccccgcccagtgacacccggggcaaccccatcactgcctacaccattgagcggtgccagggcgagtctggggaatggatcgcctgccatgaggcccccggagggacttgtcggtgcccaatccaaggcctcgtcgaaggtcagagctatcggttccgggtgagagccatcagcagggtaggcagcagcgtcccctccaaggcctcagagttggttgtcatgggtgaccatgatgcagcccggaggaagacagagatcccctttgatctgggaaacaagatcaccatcagcacagacgcttttgaagatactgtgaccatcccctcaccgccaaccaatgtccatgccagcgagatccgagaggcctatgtggttctggcctgggaggagcccagcccccgggacagagcaccactgacgtactccctggagaagtcagtcataggtagtggcacctgggaggccatcagctcggaaagccctgtgagatccccgagattcgccgttctggacctggagaaaaagaagtcgtatgtcttcagagtgcgagcaatgaaccagtatggcctgagcgatccctcggagcccagcgaacccatcgccttgcggggcccgccagctaccctccctcctccagctcaagttcaagctttcagagacacacagacctctgtctccctgacatgggatcctgtgaaagacccagagctcctgggttattacatctactcccggaaggtggggacatctgagtggcaaacagttaacaacaaacccatccaaggcaccaggtttacagttcccgggctgaggacggggaaggagtacgagttttgtgtcaggtcagtcagcgaggctggggtaggcgagagctcagccgccaccgagcccatcagggtcaagcaggctctggctaccccgtctgccccatatggctttgccctcctgaactgcgggaagaatgaaatggtcattgggtggaaaccccccaagcgtcgtggaggtggcaagatcctgggctacttcctggaccagcatgactcggaagagctggactggcatgcggtcaatcagcagcccatccccacccgggtctgcaaggtcagtgaccttcatgaaggccacttctatgagttccgtgcccgggctgccaactgggcaggtgttggcgagctgtcggcacccagcagcctgtttgagtgcaaagagtggacaatgccccagccaggccccccgtacgatgtacgggcatccgaggtgcgggccacatccctggtgctgcagtgggaacccccactgtatatgggggctgggcctgtcacaggctatcacgtcagtttccaggaggaaggctctgagcagtggaagccggtcaccccaggccccatctctggcacccacctgagggtttccgacttgcagccaggaaagagttacgtgttccaggtacaggccatgaattcagctggtctggggcaaccgtccatgcccactgatcccgtgctcctggaggacaagccaggtgcccatgagatcgaggttggtgtggatgaagagggctttatctatttggcttttgaagcccctgaagcccccgactcctcagagtttcagtggtccaaagactacaagggcccactggacccccagagggtcaagatcgaggataaagttaacaagtccaaggtcatcctgaaagaacccggcctcgaggatttgggcacctactcagtcatagtcactgatgccgatgaagacatctccgcaagccacacgctaaccgaggaagagctggagaagctgaagaagctgagtcatgagatcagaaacccagtgatcaaactgatctccggctggaacattgacatcctggagcgaggggaggtgcggctttggctggaagtagaaaagttatctccagccgctgagctacatctaatcttcaacaacaaggagatcttcagctcgccgaaccgcaaaatcaattttgaccgagagaagggcctggtggaagtgatcatccagaacttgtctgaggaggacaaagggtcgtacaccgctcaactccaagatggaaaagccaaaaaccagattaccttgacactggtggatgacgattttgacaagcttctgaggaaggcagatgctaagagaagggactggaagagaaaacagggtccctattttgagcggccgttgcagtggaaggtcacggaggactgccaagtgcagctgacgtgcaaggtgaccaacaccaagaaggagactcgctttcagtggttcttccagagggcagagatgccagatggtcagtatgacccagagacgggaacgggacttctctgcattgaagagttgtccaaaaaggacaagggaatttacagagcgatggtttctgacgatcgaggggaggacgacaccatattggacctcacgggtgacgccctggatgccatcttcaccgagttgggcaggattggtgccctctctgcaactccactgaaaatccaggggaccgaggaagggatccggatcttcagcaaggtcaagtactacaacgtggagtacatgaaaaccacctggttccacaaagacaaacgtctggagagtggtgatcggataaggacgggcaccaccctggatgagatctggcttcacatcctggaccccaaagactcagacaagggcaaatacactctggaaatagctgcagggaaggaagtccggcagctctcaacagatctctcagggcaagcttttgaggatgcaatggctgaacaccagagactgaaaaccttggccatcatcgagaagaatcgtgccaaagtggtgagaggtctgccggatgtggccactatcatggaagataagaccctgtgcttgacttgcatcgtctcaggagaccccacccctgaaatctcttggctgaagaatgaccagcctgtcaccttccttgaccgataccgcatggaagtgagggggacagaggtcaccatcaccattgagaaggtcaacagtgaagacagcggccgctacggcgtcttcgtcaagaacaagtatggctccgagacgggccaggtcaccatcagtgtgttcaagcacggggacgagcccaaggagctgaagagcatgtgacagcgtgtgtccaggcacagtctgagtctagtctacatggaccagtagggacaacctgtaccagggtcacagcctggcacaggctacaggggtggggcagaaggaaaggggacaagatagaacccaggatgtgagggtgggggtggagcggatgcaccaaagtggagaagcaaagatctttctggggtcctgagtggcttccaggagagcgggatgaaccctggacctggagtaggagacccggatgcactggggctatctaacagtactggcatctgataggtagaggtcaggtacgctgctaaacactgcagctcccaccacatagaattatccgaccccagatgtcaaaagtgccaagggccatgagccctgccataaactgatacatcgcacccctcttttaggatcccatagtttcaattcatgtaagttcaacagacacctgaagtctagcatgtgggaggctgaggatggagctgggaacacaaaggcagctgataagcaggttctgcttgcaaagaggcctcagtccagtgggagaaacagacctgggcgcaaacaactccaggacaaggcaggacatgataaagattataaagcaggtccaaggaaagtgccgccagtggtccaaggagggagacagagggtcgtcccaacagggggaggtagggctttgaaaacaccttcatccaggctgggcgaggtggctcacgcctgtaatcccagtagtttgggaggccaaggcgggcagatcacctgaggtcaggagttttagaccagcctggccaacatgacgaaacccggtctctactaaaaatacaaaaattagccaggcatggtggcaggtgcctgtaatcccggctattcagaaggccgaggtgggagaatccgttgaacctgggaggcggaggttgtgatgagccaagattgagccaaaaaaaaattagcagaattggtgttgggccctgaaaaattagtccgattttgtggtggtaatgggagaaggacatcccaggagcagggtctggtgggaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaacaccacaaa

SEQ ID NO: 156676 - DNA, 4999 bp, Homo sapiens
  Payload ID: 10715
  Gene Symbol: MYNN
  Gene Name: myoneurin
  Uniprot ID: Q9NPC7
  ENST ID: ENST00000349841
  CDS Start-End: 664-2496
aggtaagggcatcttggaagctgagctacagttggctggggcacaaaaaaaccagggggtgccaagagttttcaggtacgtaagcgggaaaggggtgccaagtctcagctaaaaaatcccctatggcagagatccgagtacacatgcagcagtttccaccggtggggccccgaggaaggggaggatgatgggagaagacaagcaactacaagcccccgcacgcagtgcgcagctggcttcaggagagaggcccgcggtgctgtgctgccgggcctcggcgcagagccccggcagagcgccagacgctgactgccggcaccagaatgctcgcgatgaggaagacaggcggagcgctgcgagctagcgagccctcagctctcgtatccatgacgcctgctgcttcgggggacccctggcatgctggggagtgggtctctgtggtacatcctgtaccgccctggccggcgccggacccccatggccccagaacctcccgcactgccacgggaagacagagccggacgtgacgccaccgtggaaggaagggaggggcggagcgtggctcggtgacgtcctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatgg

SEQ ID NO: 156677 - DNA, 2833 bp, Homo sapiens
  Payload ID: 10715
  Gene Symbol: MYNN
  Gene Name: myoneurin
  Uniprot ID: Q9NPC7
  ENST ID: ENST00000356716
  CDS Start-End: 135-1967
gtgaagaaactgtgttccccccttgggttgctatcggtggtagaagtgttgccattcaccgtcacttattgatgtgtccaaaggattgtgttagttgatcaagatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattc

SEQ ID NO: 156678 - DNA, 4815 bp, Homo sapiens
  Payload ID: 10715
  Gene Symbol: MYNN
  Gene Name: myoneurin
  Uniprot ID: Q9NPC7
  ENST ID: ENST00000544106
  CDS Start-End: 32-1777
atcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggt

SEQ ID NO: 156679 - DNA, 880 bp, Homo sapiens
  Payload ID: 10715
  Gene Symbol: MYNN
  Gene Name: myoneurin
  ENST ID: ENST00000602391
  CDS Start-End: 1-716
cacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacagttgtttggagtatgaattaaatttgttaaagaattgtgttggttttccaagaaatatgccagataatcaatagtttttaaatgatttggattaaattgcacagatataccaagaaatgaaaaggaataggagaaagaccatttatctgcgaattatgtggaaattcttacacagatattaaaaa

SEQ ID NO: 156680 - DNA, 2630 bp, Homo sapiens
  Payload ID: 10715
  Gene Symbol: MYNN
  Gene Name: myoneurin
  Uniprot ID: Q9NPC7
  ENST ID: ENST00000602751
  CDS Start-End: 90-365
ctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctc

SEQ ID NO: 156681 - DNA, 4596 bp, Homo sapiens
  Payload ID: 10716
  Gene Symbol: MYPN
  Gene Name: myopalladin
  Uniprot ID: Q86TC9
  ENST ID: ENST00000354393
  CDS Start-End: 215-3352
atataggaatggtgcttctcctgagacagaggttttgtttagttttttcatctgatactggatatgtcaagatgaatctatgaacttcaagcaaaacttattgaagctttggtatatgtgagtaatttgttttagagaactggagcctatagcgatataaaaaaatagcaaatgcaaacattttatatgaatctactagcatggaaattctcccatgcttaccgtccaagtgaagacttcctctgccatagaacttccagattccttggcattcctgtggatcatcccaatgtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccagaggagatttgcaccttggtcattgctgaggtgtttgcagaagattctgggtgcttcacatgtactgcaagcaacaaatacggcacagtgtcaagcattgcacagctgcacgtgagaggaaatgaggacctcagcaacaacgggtctcttcactcagccaactctaccaccaacctggcagctattgagccacagccctccccaccccactcagagcctccatctgtggaacaaccccccaaacccaaactcgagggggttctggtgaaccacaatgagccccggtccagctccaggattgggcttcgtgtgcacttcaacctgcctgaagatgacaaaggaagtgaagcatcctccgaggctggtgtggtgaccaccagacagaccaggcccgattctttccaggagaggttcaacggacaggcaacaaaaaccccagagccttcttcccccgtgaaagagccccctccagttctggccaaacccaaacttgattccactcagttacaacagcttcataaccaagtcttactggaacaacaccaattgcaaaacccacctccttcatctcctaaggagtttcctttcagcatgactgttttgaactccaatgctcccccagcggtgacaacatccagtaagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccagcggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgccatcccagggattagcgaagaaaaatacaaagtctcctcaaccagtgaatgatgataacattcgtgaaactaagaacgcagtgattcgagacttggggaaaaaaataactttcagtgatgtcagaccaaaccagcaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagttacattcacctgcaaaattgttgggatacctgttccaaaggtttactggttcaaagatgggaagcagatttctaagagaaatgagcactgcaaaatgaggcgagaaggagatgggacatgctctctgcacattgaatccactaccagtgatgacgatggcaactacaccatcatggcagccaacccccaggggagaatcagctgttctggccacttgatggtacaaagtttgcccattcgcagtcggctaacctctgctggtcagtctcacaggggaagatcccgagtgcaagaaagagacaaagagcccctacaggaacgctttttccgaccacatttcctgcaggctcctggggatatggtagctcatgaggggcgcctctgtcggctggactgtaaggtgagtggtttaccgcccccggagctgacatggctactcaatggccaacctgtgctaccagatgcctcccacaagatgctggtcagggagaccggagtccactctctgctcattgacccactcactcagcgcgacgcagggacctataagtgcatcgctaccaacaaaaccgggcagaattcttttagtctggagctctctgtagtagccaaagaggtgaagaaagcacctgtgatcctggagaaactacagaactgcggtgttcccgaaggccaccccgtgagactggagtgccgcgtgataggcatgcccccacctgtgttctactggaagaaagacaatgagaccatcccttgcaccagagagaggatcagtatgcaccaggacacaacagggtatgcctgccttctcattcagccagccaagaaatcagacgctggatggtacacgttgtcagccaagaatgaagccggcatcgtgtcgtgcactgccaggctggatatatacgctcagtggcaccatcagatcccaccgcccatgtctgtccggcccagtggcagtcgctacggatctctcaccagtaaaggacttgacatattttctgccttttcctccatggaaagcacgatggtgtattcatgctcttctcggagtgtagtggagagtgatgaactttaagaatgtctaggtacctgctgtgtaagagagcggactgtggagggggaatgagaacaagccagacttggtggtttccaagcaaccgaagttgagtaagttcccacactgctggacctgtggcaaagagtgctttgaataagtcagctagggattcttgcagtctcagctgagggagaaaggtagggctgtgccttctaaagattccaacagagatgtgagaagataatacagatgaaccaaagatgtcacacagttgccatccactgctttgggaaaaaactagcatgctcccctgctccctgttgtgttagggatgtttaggtcatactaggagcaattaggagccatatgcctgggctgagaagagctaggcagtagtgaccttaggatatgactaactcaccaaacaatgccaaggagaaaggcggacaggtcaccatcacctttcatcgattacatgtatagcagtagttttggtgaattcaccaaatcagcttccacttagcattaggaggtcatgccatacaactcacgtatgcgggcaaacacttttgatttgcatatcctgggtgtactgagccacataataaggtgtcaaaatgtgcttgagattccaaaaacttgctgaaacacttgatattgcacagtgcacttattttgtggccaaagcatggccttaccagcttgtctgcactattttcttttgggtggtgactgtttttttctgactttgcatatccctagacactagaactaaaggattggtaataaaccaatcagaaagaaatcctctgtggggtcactttaaaaactactagcttcaactaccacttacaaaatgtgcaagagtcatcatttgcccataaaatacacctcatgggctcctacccctttccccaaaagtctgaaagtgtaggaggaaggaagagatacaaacaaggagaggaaatgatgggagagtgttgtttttgtcacttgccccagcagagcaggggttttggaaggagaggtctttaatagctttgaaatgctttgagatcattggtcaaattgcattttctatgtagagaatattctgctaggtggaaaagttgggagaaaggggaatatgcatctttattctaatcaccaattcaaaccctgcctcttaaggaatttttagacttaagttcactgtgatatccctagtacctagaagagtacctagcacaaagtagacattcaataaatatttgctggttgaa

SEQ ID NO: 156682 - DNA, 6013 bp, Homo sapiens
  Payload ID: 10716
  Gene Symbol: MYPN
  Gene Name: myopalladin
  Uniprot ID: Q86TC9
  ENST ID: ENST00000358913
  CDS Start-End: 489-4451
aaaaataatgccatttttttgaatgatgaactatggtataatgcatttagtgttcattccaaacgtcaatcaataaataacatgggcctctagctataagggaaattctataggtaaaagaactgattgacccccacccccataggtgctgtcctgctatggaatccctttgctcagttttctcctgtccaatcaggtggaatgtttcacaggcacatggtttatacagctcaaaataacttgggacctgtgagctgacaaatgctctggctccggtggtgacaggttgtccagcttcttacagccatcttcactgaaactaaggttaactcctcactctctatggacggctactctctatttccaagggcgtgaagaatttccctcttctcctgtgctttcatctaaaagttctccctggataattatcattgcagtggagtgcctggattggacatcctcatctgggtcaactaaaaaaagaaagcatgcaagacgacagcatagaagcttctacttccatatctcagcttctaagagagagctatttagctgaaaccagacatcggggaaacaatgagaggagtcgagcggagccctcctccaacccttgccatttcggcagtccttctggggccgctgaaggaggcggaggccaagatgaccttccagatctttcagcctttctgagccaagaagaattagacgaaagtgtcaatttggcaagactggccatcaattacgaccctttggagaaggcagatgaaactcaagctagaaaacgactttctcctgatcagatgaaacactcacctaatttaagttttgagcctaacttctgccaggataaccctcgaagtcccaccagctctaaagaaagcccccaggaggcaaaaaggccacagtattgttctgaaacccagtccaaaaaagtatttttaaataaggctgccgacttcattgaagagctatcctcccttttcaaatcccacagctccaaaaggattagacctcgtgcctgcaaaaaccacaagagtaaactggaatctcaaaacaaagttatgcaggaaaacagctccagtttctcagatctgtcagaaagacgagaaagatcttctgttcccatccctatccctgcggataccagggataatgaagtgaatcacgccctggaacagcaggaagccaagaggcgtgaagcggagcaggctgccagtgaggcggctggtggagacactacaccagggtcttccccttcatctctgtactatgaagaacctctggggcaacctccccggttcactcaaaagttacggagcagagaagttccagaaggaactcgagtacagttggattgcatagtggtaggaattccaccacctcaagtaaggtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccagaggagatttgcaccttggtcattgctgaggtgtttgcagaagattctgggtgcttcacatgtactgcaagcaacaaatacggcacagtgtcaagcattgcacagctgcacgtgagaggaaatgaggacctcagcaacaacgggtctcttcactcagccaactctaccaccaacctggcagctattgagccacagccctccccaccccactcagagcctccatctgtggaacaaccccccaaacccaaactcgagggggttctggtgaaccacaatgagccccggtccagctccaggattgggcttcgtgtgcacttcaacctgcctgaagatgacaaaggaagtgaagcatcctccgaggctggtgtggtgaccaccagacagaccaggcccgattctttccaggagaggttcaacggacaggcaacaaaaaccccagagccttcttcccccgtgaaagagccccctccagttctggccaaacccaaacttgattccactcagttacaacagcttcataaccaagtcttactggaacaacaccaattgcaaaacccacctccttcatctcctaaggagtttcctttcagcatgactgttttgaactccaatgctcccccagcggtgacaacatccagtaagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccagcggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgccatcccagggattagcgaagaaaaatacaaagtctcctcaaccagtgaatgatgataacattcgtgaaactaagaacgcagtgattcgagacttggggaaaaaaataactttcagtgatgtcagaccaaaccagcaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagttacattcacctgcaaaattgttgggatacctgttccaaaggtttactggttcaaagatgggaagcagatttctaagagaaatgagcactgcaaaatgaggcgagaaggagatgggacatgctctctgcacattgaatccactaccagtgatgacgatggcaactacaccatcatggcagccaacccccaggggagaatcagctgttctggccacttgatggtacaaagtttgcccattcgcagtcggctaacctctgctggtcagtctcacaggggaagatcccgagtgcaagaaagagacaaagagcccctacaggaacgctttttccgaccacatttcctgcaggctcctggggatatggtagctcatgaggggcgcctctgtcggctggactgtaaggtgagtggtttaccgcccccggagctgacatggctactcaatggccaacctgtgctaccagatgcctcccacaagatgctggtcagggagaccggagtccactctctgctcattgacccactcactcagcgcgacgcagggacctataagtgcatcgctaccaacaaaaccgggcagaattcttttagtctggagctctctgtagtagccaaagaggtgaagaaagcacctgtgatcctggagaaactacagaactgcggtgttcccgaaggccaccccgtgagactggagtgccgcgtgataggcatgcccccacctgtgttctactggaagaaagacaatgagaccatcccttgcaccagagagaggatcagtatgcaccaggacacaacagggtatgcctgccttctcattcagccagccaagaaatcagacgctggatggtacacgttgtcagccaagaatgaagccggcatcgtgtcgtgcactgccaggctggatatatacgctcagtggcaccatcagatcccaccgcccatgtctgtccggcccagtggcagtcgctacggatctctcaccagtaaaggacttgacatattttctgccttttcctccatggaaagcacgatggtgtattcatgctcttctcggagtgtagtggagagtgatgaactttaagaatgtctaggtacctgctgtgtaagagagcggactgtggagggggaatgagaacaagccagacttggtggtttccaagcaaccgaagttgagtaagttcccacactgctggacctgtggcaaagagtgctttgaataagtcagctagggattcttgcagtctcagctgagggagaaaggtagggctgtgccttctaaagattccaacagagatgtgagaagataatacagatgaaccaaagatgtcacacagttgccatccactgctttgggaaaaaactagcatgctcccctgctccctgttgtgttagggatgtttaggtcatactaggagcaattaggagccatatgcctgggctgagaagagctaggcagtagtgaccttaggatatgactaactcaccaaacaatgccaaggagaaaggcggacaggtcaccatcacctttcatcgattacatgtatagcagtagttttggtgaattcaccaaatcagcttccacttagcattaggaggtcatgccatacaactcacgtatgcgggcaaacacttttgatttgcatatcctgggtgtactgagccacataataaggtgtcaaaatgtgcttgagattccaaaaacttgctgaaacacttgatattgcacagtgcacttattttgtggccaaagcatggccttaccagcttgtctgcactattttcttttgggtggtgactgtttttttctgactttgcatatccctagacactagaactaaaggattggtaataaaccaatcagaaagaaatcctctgtggggtcactttaaaaactactagcttcaactaccacttacaaaatgtgcaagagtcatcatttgcccataaaatacacctcatgggctcctacccctttccccaaaagtctgaaagtgtaggaggaaggaagagatacaaacaaggagaggaaatgatgggagagtgttgtttttgtcacttgccccagcagagcaggggttttggaaggagaggtctttaatagctttgaaatgctttgagatcattggtcaaattgcattttctatgtagagaatattctgctaggtggaaaagttgggagaaaggggaatatgcatctttattctaatcaccaattcaaaccctgcctcttaaggaatttttagacttaagttcactgtgatatccctagtacctagaagagtacctagcacaaagtagacattcaataaatatttgctggttgaatgaatcttctgttattatgtctattataagataacctaatcttatattctgcaggaatatgccacccacacaccagtccaaacactgccctgggaatgctcatcacagcacagtttgctctaggctgtgcagggaaatgaattgcaggtgtctgttttcaattccctgtgctggaatccctggtgctgtctgtgccaagcacactcagctggcattgtatttgtgtgaacagacagtaactgcttagaaaggcttgaaactgtcttcacttcaaggcaaggatttccagcataaaaataaattcattcactggagaaa

SEQ ID NO: 156683 - DNA, 2126 bp, Homo sapiens
  Payload ID: 10716
  Gene Symbol: MYPN
  Gene Name: myopalladin
  Uniprot ID: Q86TC9
  ENST ID: ENST00000373675
  CDS Start-End: 230-1753
aaatgctctggctccggtggtgacaggttgtccagcttcttacagccatcttcactgaaactaaggttaactcctcactctctatggacggctactctctatttccaagggcgtgaagaatttccctcttctcctgtgctttcatctaaaagttctccctggataattatcattgcagtggagtgcctggattggacatcctcatctgggtcaactaaaaaaagaaagcatgcaagacgacagcatagaagcttctacttccatatctcagcttctaagagagagctatttagctgaaaccagacatcggggaaacaatgagaggagtcgagcggagccctcctccaacccttgccatttcggcagtccttctggggccgctgaaggaggcggaggccaagatgaccttccagatctttcagcctttctgagccaagaagaattagacgaaagtgtcaatttggcaagactggccatcaattacgaccctttggagaaggcagatgaaactcaagctagaaaacgactttctcctgatcagatgaaacactcacctaatttaagttttgagcctaacttctgccaggataaccctcgaagtcccaccagctctaaagaaagcccccaggaggcaaaaaggccacagtattgttctgaaacccagtccaaaaaagtatttttaaataaggctgccgacttcattgaagagctatcctcccttttcaaatcccacagctccaaaaggattagacctcgtgcctgcaaaaaccacaagagtaaactggaatctcaaaacaaagttatgcaggaaaacagctccagtttctcagatctgtcagaaagacgagaaagatcttctgttcccatccctatccctgcggataccagggataatgaagtgaatcacgccctggaacagcaggaagccaagaggcgtgaagcggagcaggctgccagtgaggcggctggtggagacactacaccagggtcttccccttcatctctgtactatgaagaacctctggggcaacctccccggttcactcaaaagttacggagcagagaagttccagaaggaactcgagtacagttggattgcatagtggtaggaattccaccacctcaagtaaggtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccaggtaaagatgatttcaactttaatttattagtatatgagtgattttatatatacaagaatacataatgaagttacactgagatgaataaaaagtgaaaaataaagttttaggaaaaaaagatccaaatgggccgggtgcagtggctcatgtctgtaattccagcactttgcgaggccgaggcgggcggattacttgagatcagaagttcaagaccagcctggcctacatgacaaaatgaaaccccatctctactaaaaatataaaaattagccaggcatagtggcgcacgtctgtaatcccagctacctgggaggctgaggcaggagaatcacttgagcctgggaggtggaggttgcagtgagccgagatcgtgacactacagtccagctgcgcgacagaacaagaatctgtctc

SEQ ID NO: 156684 - DNA, 5707 bp, Homo sapiens
  Payload ID: 10716
  Gene Symbol: MYPN
  Gene Name: myopalladin
  Uniprot ID: Q86TC9
  ENST ID: ENST00000540630
  CDS Start-End: 188-4150
gcagtgagatttggactttagatgatcctggttgattgatataggaatggtgcttctcctgagacagggcgtgaagaatttccctcttctcctgtgctttcatctaaaagttctccctggataattatcattgcagtggagtgcctggattggacatcctcatctgggtcaactaaaaaaagaaagcatgcaagacgacagcatagaagcttctacttccatatctcagcttctaagagagagctatttagctgaaaccagacatcggggaaacaatgagaggagtcgagcggagccctcctccaacccttgccatttcggcagtccttctggggccgctgaaggaggcggaggccaagatgaccttccagatctttcagcctttctgagccaagaagaattagacgaaagtgtcaatttggcaagactggccatcaattacgaccctttggagaaggcagatgaaactcaagctagaaaacgactttctcctgatcagatgaaacactcacctaatttaagttttgagcctaacttctgccaggataaccctcgaagtcccaccagctctaaagaaagcccccaggaggcaaaaaggccacagtattgttctgaaacccagtccaaaaaagtatttttaaataaggctgccgacttcattgaagagctatcctcccttttcaaatcccacagctccaaaaggattagacctcgtgcctgcaaaaaccacaagagtaaactggaatctcaaaacaaagttatgcaggaaaacagctccagtttctcagatctgtcagaaagacgagaaagatcttctgttcccatccctatccctgcggataccagggataatgaagtgaatcacgccctggaacagcaggaagccaagaggcgtgaagcggagcaggctgccagtgaggcggctggtggagacactacaccagggtcttccccttcatctctgtactatgaagaacctctggggcaacctccccggttcactcaaaagttacggagcagagaagttccagaaggaactcgagtacagttggattgcatagtggtaggaattccaccacctcaagtaaggtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccagaggagatttgcaccttggtcattgctgaggtgtttgcagaagattctgggtgcttcacatgtactgcaagcaacaaatacggcacagtgtcaagcattgcacagctgcacgtgagaggaaatgaggacctcagcaacaacgggtctcttcactcagccaactctaccaccaacctggcagctattgagccacagccctccccaccccactcagagcctccatctgtggaacaaccccccaaacccaaactcgagggggttctggtgaaccacaatgagccccggtccagctccaggattgggcttcgtgtgcacttcaacctgcctgaagatgacaaaggaagtgaagcatcctccgaggctggtgtggtgaccaccagacagaccaggcccgattctttccaggagaggttcaacggacaggcaacaaaaaccccagagccttcttcccccgtgaaagagccccctccagttctggccaaacccaaacttgattccactcagttacaacagcttcataaccaagtcttactggaacaacaccaattgcaaaacccacctccttcatctcctaaggagtttcctttcagcatgactgttttgaactccaatgctcccccagcggtgacaacatccagtaagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccagcggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgccatcccagggattagcgaagaaaaatacaaagtctcctcaaccagtgaatgatgataacattcgtgaaactaagaacgcagtgattcgagacttggggaaaaaaataactttcagtgatgtcagaccaaaccagcaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagttacattcacctgcaaaattgttgggatacctgttccaaaggtttactggttcaaagatgggaagcagatttctaagagaaatgagcactgcaaaatgaggcgagaaggagatgggacatgctctctgcacattgaatccactaccagtgatgacgatggcaactacaccatcatggcagccaacccccaggggagaatcagctgttctggccacttgatggtacaaagtttgcccattcgcagtcggctaacctctgctggtcagtctcacaggggaagatcccgagtgcaagaaagagacaaagagcccctacaggaacgctttttccgaccacatttcctgcaggctcctggggatatggtagctcatgaggggcgcctctgtcggctggactgtaaggtgagtggtttaccgcccccggagctgacatggctactcaatggccaacctgtgctaccagatgcctcccacaagatgctggtcagggagaccggagtccactctctgctcattgacccactcactcagcgcgacgcagggacctataagtgcatcgctaccaacaaaaccgggcagaattcttttagtctggagctctctgtagtagccaaagaggtgaagaaagcacctgtgatcctggagaaactacagaactgcggtgttcccgaaggccaccccgtgagactggagtgccgcgtgataggcatgcccccacctgtgttctactggaagaaagacaatgagaccatcccttgcaccagagagaggatcagtatgcaccaggacacaacagggtatgcctgccttctcattcagccagccaagaaatcagacgctggatggtacacgttgtcagccaagaatgaagccggcatcgtgtcgtgcactgccaggctggatatatacgctcagtggcaccatcagatcccaccgcccatgtctgtccggcccagtggcagtcgctacggatctctcaccagtaaaggacttgacatattttctgccttttcctccatggaaagcacgatggtgtattcatgctcttctcggagtgtagtggagagtgatgaactttaagaatgtctaggtacctgctgtgtaagagagcggactgtggagggggaatgagaacaagccagacttggtggtttccaagcaaccgaagttgagtaagttcccacactgctggacctgtggcaaagagtgctttgaataagtcagctagggattcttgcagtctcagctgagggagaaaggtagggctgtgccttctaaagattccaacagagatgtgagaagataatacagatgaaccaaagatgtcacacagttgccatccactgctttgggaaaaaactagcatgctcccctgctccctgttgtgttagggatgtttaggtcatactaggagcaattaggagccatatgcctgggctgagaagagctaggcagtagtgaccttaggatatgactaactcaccaaacaatgccaaggagaaaggcggacaggtcaccatcacctttcatcgattacatgtatagcagtagttttggtgaattcaccaaatcagcttccacttagcattaggaggtcatgccatacaactcacgtatgcgggcaaacacttttgatttgcatatcctgggtgtactgagccacataataaggtgtcaaaatgtgcttgagattccaaaaacttgctgaaacacttgatattgcacagtgcacttattttgtggccaaagcatggccttaccagcttgtctgcactattttcttttgggtggtgactgtttttttctgactttgcatatccctagacactagaactaaaggattggtaataaaccaatcagaaagaaatcctctgtggggtcactttaaaaactactagcttcaactaccacttacaaaatgtgcaagagtcatcatttgcccataaaatacacctcatgggctcctacccctttccccaaaagtctgaaagtgtaggaggaaggaagagatacaaacaaggagaggaaatgatgggagagtgttgtttttgtcacttgccccagcagagcaggggttttggaaggagaggtctttaatagctttgaaatgctttgagatcattggtcaaattgcattttctatgtagagaatattctgctaggtggaaaagttgggagaaaggggaatatgcatctttattctaatcaccaattcaaaccctgcctcttaaggaatttttagacttaagttcactgtgatatccctagtacctagaagagtacctagcacaaagtagacattcaataaatatttgctggttgaatgaatcttctgttattatgtctattataagataacctaatcttatattctgcaggaatatgccacccacacaccagtccaaacactgccctgggaatgctcatcacagcacagtttgctctaggctgtgcagggaaatgaattgcaggtgtctgttttcaattccctgtgctggaatccctggtgctgtctgtgccaagcacactcagctggcattgtatttgtgtgaacagacagtaactgcttagaaaggcttgaaactgtcttcacttcaaggcaaggatttccagcataaaaataaattcattcactgg

SEQ ID NO: 156685 - DNA, 6116 bp, Homo sapiens
  Payload ID: 10716
  Gene Symbol: MYPN
  Gene Name: myopalladin
  ENST ID: ENST00000613327
  CDS Start-End: 1479-4559
gtggaatgtttcacaggcacatggtttatacagctcaaaataacttgggacctgtgagctgacaaatgctctggctccggtggtgacaggttgtccagcttcttacagccatcttcactgaaactaaggttaactcctcactctctatggacggctactctctatttccaagggcgtgaagaatttccctcttctcctgtgctttcatctaaaagttctccctggataattatcattgcagtggagtgcctggattggacatcctcatctgggtcaactaaaaaaagaaagggtcttcttagagcctgaagaaggatagcaccgagttaacatgagttgaaaaacatgtccaaagcatgcaagacgacagcatagaagcttctacttccatatctcagcttctaagagagagctatttagctgaaaccagacatcggggaaacaatgagaggagtcgagcggagccctcctccaacccttgccatttcggcagtccttctggggccgctgaaggaggcggaggccaagatgaccttccagatctttcagcctttctgagccaagaagaattagacgaaagtgtcaatttggcaagactggccatcaattacgaccctttggagaaggcagatgaaactcaagctagaaaacgactttctcctgatcagatgaaacactcacctaatttaagttttgagcctaacttctgccaggataaccctcgaagtcccaccagctctaaagaaagcccccaggaggcaaaaaggccacagtattgttctgaaacccagtccaaaaaagtatttttaaataaggctgccgacttcattgaagagctatcctcccttttcaaatcccacagctccaaaaggattagacctcgtgcctgcaaaaaccacaagagtaaactggaatctcaaaacaaagttatgcaggaaaacagctccagtttctcagatctgtcagaaagacgagaaagatcttctgttcccatccctatccctgcggataccagggataatgaagtgaatcacgccctggaacagcaggaagccaagaggcgtgaagcggagcaggctgccagtgaggcggctggtggagacactacaccagggtcttccccttcatctctgtactatgaagaacctctggggcaacctccccggttcactcaaaagttacggagcagagaagttccagaaggaactcgagtacagttggattgcatagtggtaggaattccaccacctcaagtaagttgcactctgtatatgaagaagagttactctgatgcttggagagagctggaaatgcttgctagctagccaaatgagcagatctggcaagccatccttgtgcgtgaaaggcctgctgaggccatcctggccatctgagtaaggacaaaaacacttctgacagagagtttgggcatttgaatcattccacttatctccttctggctatccaattgctcatagatgtttccactctcattttggtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccagaggagatttgcaccttggtcattgctgaggtgtttgcagaagattctgggtgcttcacatgtactgcaagcaacaaatacggcacagtgtcaagcattgcacagctgcacgtgagaggaaatgaggacctcagcaacaacgggtctcttcactcagccaactctaccaccaacctggcagctattgagccacagccctccccaccccactcagagcctccatctgtggaacaaccccccaaacccaaactcgagggggttctggtgaaccacaatgagccccggtccagctccaggattgggcttcgtgtgcacttcaacctgcctgaagatgacaaaggaagtgaagcatcctccgaggctggtgtggtgaccaccagacagaccaggcccgattctttccaggagaggttcaacggacaggcaacaaaaaccccagagccttcttcccccgtgaaagagccccctccagttctggccaaacccaaacttgattccactcagttacaacagcttcataaccaagtcttactggaacaacaccaattgcaaaacccacctccttcatctcctaaggagtttcctttcagcatgactgttttgaactccaatgctcccccagcggtgacaacatccagtaagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccagcggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgccatcccagggattagcgaagaaaaatacaaagtctcctcaaccagtgaatgatgataacattcgtgaaactaagaacgcagtgattcgagacttggggaaaaaaataactttcagtgatgtcagaccaaaccagcaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagttacattcacctgcaaaattgttgggatacctgttccaaaggtttactggttcaaagatgggaagcagatttctaagagaaatgagcactgcaaaatgaggcgagaaggagatgggacatgctctctgcacattgaatccactaccagtgatgacgatggcaactacaccatcatggcagccaacccccaggggagaatcagctgttctggccacttgatggtacaaagtttgcccattcgcagtcggctaacctctgctggtcagtctcacaggggaagatcccgagtgcaagaaagagacaaagagcccctacaggaacgctttttccgaccacatttcctgcaggctcctggggatatggtagctcatgaggggcgcctctgtcggctggactgtaaggtgagtggtttaccgcccccggagctgacatggctactcaatggccaacctgtgctaccagatgcctcccacaagatgctggtcagggagaccggagtccactctctgctcattgacccactcactcagcgcgacgcagggacctataagtgcatcgctaccaacaaaaccgggcagaattcttttagtctggagctctctgtagtagccaaagaggtgaagaaagcacctgtgatcctggagaaactacagaactgcggtgttcccgaaggccaccccgtgagactggagtgccgcgtgataggcatgcccccacctgtgttctactggaagaaagacaatgagaccatcccttgcaccagagagaggatcagtatgcaccaggacacaacagggtatgcctgccttctcattcagccagccaagaaatcagacgctggatggtacacgttgtcagccaagaatgaagccggcatcgtgtcgtgcactgccaggctggatatatacgctcagtggcaccatcagatcccaccgcccatgtctgtccggcccagtggcagtcgctacggatctctcaccagtaaaggacttgacatattttctgccttttcctccatggaaagcacgatggtgtattcatgctcttctcggagtgtagtggagagtgatgaactttaagaatgtctaggtacctgctgtgtaagagagcggactgtggagggggaatgagaacaagccagacttggtggtttccaagcaaccgaagttgagtaagttcccacactgctggacctgtggcaaagagtgctttgaataagtcagctagggattcttgcagtctcagctgagggagaaaggtagggctgtgccttctaaagattccaacagagatgtgagaagataatacagatgaaccaaagatgtcacacagttgccatccactgctttgggaaaaaactagcatgctcccctgctccctgttgtgttagggatgtttaggtcatactaggagcaattaggagccatatgcctgggctgagaagagctaggcagtagtgaccttaggatatgactaactcaccaaacaatgccaaggagaaaggcggacaggtcaccatcacctttcatcgattacatgtatagcagtagttttggtgaattcaccaaatcagcttccacttagcattaggaggtcatgccatacaactcacgtatgcgggcaaacacttttgatttgcatatcctgggtgtactgagccacataataaggtgtcaaaatgtgcttgagattccaaaaacttgctgaaacacttgatattgcacagtgcacttattttgtggccaaagcatggccttaccagcttgtctgcactattttcttttgggtggtgactgtttttttctgactttgcatatccctagacactagaactaaaggattggtaataaaccaatcagaaagaaatcctctgtggggtcactttaaaaactactagcttcaactaccacttacaaaatgtgcaagagtcatcatttgcccataaaatacacctcatgggctcctacccctttccccaaaagtctgaaagtgtaggaggaaggaagagatacaaacaaggagaggaaatgatgggagagtgttgtttttgtcacttgccccagcagagcaggggttttggaaggagaggtctttaatagctttgaaatgctttgagatcattggtcaaattgcattttctatgtagagaatattctgctaggtggaaaagttgggagaaaggggaatatgcatctttattctaatcaccaattcaaaccctgcctcttaaggaatttttagacttaagttcactgtgatatccctagtacctagaagagtacctagcacaaagtagacattcaataaatatttgctggttgaatgaatcttctgttattatgtctattataagataacctaatcttatattctgcaggaatatgccacccacacaccagtccaaacactgccctgggaatgctcatcacagcacagtttgctctaggctgtgcagggaaatgaattgcaggtgtctgttttcaattccctgtgctggaatccctggtgctgtctgtgccaagcacactcagctggcattgtatttgtgtgaacagacagtaactgcttagaaaggcttgaaactgtcttcacttcaaggcaaggatttccagcataaaaataaattcattcactgg

SEQ ID NO: 156686 - DNA, 281 bp, Homo sapiens
  Payload ID: 10717
  Gene Symbol: MRLN
  Gene Name: myoregulin
  ENST ID: ENST00000599605
  CDS Start-End: 31-33
aatccatttaacccttagtggacacagaacatgtttcagagagcacggagttgggggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatg

SEQ ID NO: 156687 - DNA, 495 bp, Homo sapiens
  Payload ID: 10717
  Gene Symbol: MRLN
  Gene Name: myoregulin
  Uniprot ID: P0DMT0
  ENST ID: ENST00000430431
  CDS Start-End: 290-430
tcattcccttgactttggacttcgcttattgaacccctggacaacggaatctccctctgtcgcccaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaa

SEQ ID NO: 156688 - DNA, 644 bp, Homo sapiens
  Payload ID: 10717
  Gene Symbol: MRLN
  Gene Name: myoregulin
  Uniprot ID: P0DMT0
  ENST ID: ENST00000628562
  CDS Start-End: 136-276
atttgacacaggaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaacttgttgagtgactcacattttatgacattgccaatttattctagaagccaacaggacactgcaatacaaacaacattgtgtattgtttagttctttatggtttatgaaacattcacatatactgaagtgaatttttttccccaaaaacatctatcctactgagtcatgaaacttctagatttttagccaggtgtggtggctcacacctgtaatcccagcactttgagaggcccaggtaggcggatcccttgagtgcaggagttcgatacgggcctgagcaacctgaagaaatcccatctcta

SEQ ID NO: 156689 - DNA, 520 bp, Homo sapiens
  Payload ID: 10717
  Gene Symbol: MRLN
  Gene Name: myoregulin
  Uniprot ID: P0DMT0
  ENST ID: ENST00000594536
  CDS Start-End: 315-455
gcctcctgatccaccaagaccatatggtgtttttcataaaagagagagatcattcccttgactttggacttcgcttattgaacccctggacagctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaa

SEQ ID NO: 156690 - DNA, 286 bp, Homo sapiens
  Payload ID: 10717
  Gene Symbol: MRLN
  Gene Name: myoregulin
  ENST ID: ENST00000602051
  CDS Start-End: 4-6
acaatgggtggccgggcagagacgctcctcacttcctagacaggatgacggccgggaagaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatg

SEQ ID NO: 156691 - DNA, 422 bp, Homo sapiens
  Payload ID: 10717
  Gene Symbol: MRLN
  Gene Name: myoregulin
  Uniprot ID: P0DMT0
  ENST ID: ENST00000414264
  CDS Start-End: 217-357
gcctcctgatccaccaagaccatatggtgtttttcataaaagagagagatcattcccttgactttggacttcgcttattgaacccctggacagaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaa

SEQ ID NO: 156692 - DNA, 4217 bp, Homo sapiens
  Payload ID: 10718
  Gene Symbol: MYBPC3
  Gene Name: myosin binding protein C, cardiac
  ENST ID: ENST00000256993
  CDS Start-End: 56-3880
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagcagcagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaggtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactca

SEQ ID NO: 156693 - DNA, 4217 bp, Homo sapiens
  Payload ID: 10718
  Gene Symbol: MYBPC3
  Gene Name: myosin binding protein C, cardiac
  ENST ID: ENST00000399249
  CDS Start-End: 56-3880
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagcagcagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactca

SEQ ID NO: 156694 - DNA, 4226 bp, Homo sapiens
  Payload ID: 10718
  Gene Symbol: MYBPC3
  Gene Name: myosin binding protein C, cardiac
  Uniprot ID: Q14896
  ENST ID: ENST00000545968
  CDS Start-End: 56-3880
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttctca

SEQ ID NO: 156695 - DNA, 2772 bp, Homo sapiens
  Payload ID: 10718
  Gene Symbol: MYBPC3
  Gene Name: myosin binding protein C, cardiac
  ENST ID: ENST00000544791
  CDS Start-End: 56-2482
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgccaggcgcgatggcttacgcctgtaatcccagcactttgggaggcca

SEQ ID NO: 156696 - DNA, 3593 bp, Homo sapiens
  Payload ID: 10719
  Gene Symbol: MYBPC2
  Gene Name: myosin binding protein C, fast type
  Uniprot ID: Q14324
  ENST ID: ENST00000357701
  CDS Start-End: 52-3477
ggcctagcgggacgcggctgcggtcagaggagcaggaggaggtcccccgacatgcctgaggcaaaaccagcggccaaaaaggcccccaaaggcaaagatgcccccaaaggagcccccaaggaggctccccctaaggaggctcctgcagaggcccccaaagaagccccacccgaggaccagtccccgactgcagaggagcccaccggcgttttcctgaagaagccggactccgtctcagtggagactgggaaggacgcagtggtcgtggccaaggtgaacgggaaggagctcccagacaaaccgaccatcaagtggttcaaggggaagtggctggagctgggcagcaagagtggcgcccgcttctccttcaaggagtcccacaactccgccagcaatgtgtacaccgtggagctgcacattgggaaggtggtactgggggaccgtgggtattaccgcctcgaggtcaaagccaaggacacctgtgacagctgtggcttcaacatcgatgtggaggcaccccgtcaggatgcctctgggcagagtctagaaagcttcaagcgtacgagtgaaaagaagtcggatactgcaggtgagctggatttcagtggcctgttgaagaagagggaggtggtggaggaggagaagaagaagaaaaagaaagatgacgatgacctaggcatccccccggagatttgggagctcctgaaaggggcaaagaagagcgagtacgagaaaatcgccttccagtatggcatcaccgacctccggggcatgctgaagcggctgaaaaaggctaaggtcgaggtcaagaagagtgcagcattcacaaagaagctggatccagcctaccaagtggacagaggcaacaagatcaagttgatggtagagatcagcgacccagacctgaccctcaagtggttcaagaacggccaggagatcaaaccaagcagcaagtacgtgtttgagaacgttggtaagaagcgaattcttaccatcaacaagtgcacgctggcggatgacgctgcctatgaagtagctgtcaaggatgagaagtgtttcaccgagctcttcgtcaaagaacctccagtcctaattgtcacacctcttgaggaccagcaggtgtttgtgggtgaccgggtggaaatggcagtggaggtgtcagaagagggtgcccaggtgatgtggatgaaagatggtgtggaactgactcgggaggattccttcaaggcccggtaccgcttcaagaaggacgggaagcgccacatcctcatcttctcagacgtggtccaggaggacaggggtcgctatcaggtcataaccaatggcggccagtgtgaggccgagctgattgtggaagagaaacagctggaggtcctgcaggacatcgcggatctgacggtgaaggcctcagaacaagctgtgttcaagtgcgaggtgtctgatgagaaagtgacgggcaagtggtataagaatggggtcgaggtgcggcccagcaagaggatcaccatttcccatgtaggcaggttccacaagctggtgatcgatgacgtccgccccgaggatgagggagactacacgtttgtgcctgacggctacgccctgtcgctctcggccaagctcaacttcctggaaatcaaggtggagtacgttcccaagcaagagccaccaaagatccacttggattgctcggggaagacctcagagaatgcgattgtggttgtggctggaaacaagctgaggcttgacgtgtccatcacaggggagccccctcccgtcgctacctggctgaagggagatgaggtattcacgaccaccgagggcaggacccgcatcgagaagcgggtggactgcagcagctttgtgattgagagtgcgcagcgggaagacgagggccgctacaccatcaaggtcaccaaccccgtcggcgaggacgtggcttccatcttcctgcaagttgtagatgtcccagaccccccggaggctgtgcgcatcacctcggttggagaggattgggccatccttgtctgggagccaccaatgtacgatggggggaagccagtcaccgggtacctcgtagagcggaagaagaagggctctcagcgctggatgaagctgaactttgaggtcttcacagagaccacctatgagtccaccaagatgatcgagggcatcctctatgagatgcgtgtcttcgccgtcaatgctataggggtctcccagcccagcatgaacaccaagccttttatgcctattgcacccacgagtgaacccctgcacctgatagtggaggatgtgacagacaccaccaccacactcaagtggaggcctccgaacaggatcggggcaggtggcatcgatgggtacctggtggagtactgcctggaaggctccgaggaatgggtccctgccaacaccgagcccgtggagcgctgtggcttcaccgtcaagaatctcccgaccggagccagaatcctcttccgagtagttggggtcaacatcgcggggcgcagcgagccggccaccctggcccagccggtcaccatcagggagattgcggagccacccaagatccggcttccccgccatctccgccagacctacatccgcaaagtgggcgagcagctcaaccttgtcgtccccttccagggaaagccccggccccaggtggtgtggaccaagggcggggccccgctggacacctcccgcgtgcacgtgcggaccagcgacttcgacaccgtgttcttcgtgcgccaggcggcccgctccgactccggggagtacgagctgagcgtgcagatcgagaacatgaaggacaccgccaccatccgcatccgcgttgtggaaaaggctgggccccccataaacgtgatggtgaaggaggtgtggggcacgaacgcgctggtggagtggcaggcccccaaagatgatgggaacagtgagatcatggggtatttcgtccagaaagcagacaaaaaaaccatggagtggttcaacgtctatgaacgtaacaggcacactagctgtactgtgtccgaccttatcgtgggcaatgaatactatttccgagtttacaccgagaacatctgtgggctcagtgactcacctggtgtctccaagaacacggcccgcatcctcaagacaggaatcaccttcaaaccgttcgagtataaggagcatgacttccggatggctcccaagttcctgacacctctcatagaccgcgtggtcgtggctgggtactcggcagccctcaactgtgctgtcagaggccacccgaagccgaaggtggtctggatgaagaacaagatggaaatccgtgaagatcccaagttcctgataaccaattaccaaggagtcctgacgctgaacatccgtcgcccctcgcccttcgacgctgggacttacacctgccgggccgtcaacgagctgggcgaggcgctggctgagtgcaagctggaggtccgagtgccgcagtgagacctgtcccctacctgccaagacaattggtggtggagtcctgaccccaatccccaacctcccaggactgtgttctttctggagttttcgctgagaacaaaacagtgttgtctgga

SEQ ID NO: 156697 - DNA, 3871 bp, Homo sapiens
  Payload ID: 10720
  Gene Symbol: MYBPC1
  Gene Name: myosin binding protein C, slow type
  Uniprot ID: Q00872
  ENST ID: ENST00000361685
  CDS Start-End: 101-3547
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaa

SEQ ID NO: 156698 - DNA, 3899 bp, Homo sapiens
  Payload ID: 10720
  Gene Symbol: MYBPC1
  Gene Name: myosin binding protein C, slow type
  Uniprot ID: Q00872
  ENST ID: ENST00000361466
  CDS Start-End: 76-3591
gcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctca

SEQ ID NO: 156699 - DNA, 3644 bp, Homo sapiens
  Payload ID: 10720
  Gene Symbol: MYBPC1
  Gene Name: myosin binding protein C, slow type
  Uniprot ID: Q00872
  ENST ID: ENST00000392934
  CDS Start-End: 101-3520
gtcacaccgacctgcaccatctctcgcctgcctgtggggtttctgtcaactagtcgtggagggaaggagactctttaaagaataacatcttattgtggccatgccagaacccactaagaaagaggatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttg

SEQ ID NO: 156700 - DNA, 3818 bp, Homo sapiens
  Payload ID: 10720
  Gene Symbol: MYBPC1
  Gene Name: myosin binding protein C, slow type
  ENST ID: ENST00000441232
  CDS Start-End: 78-2426
tcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaatt

SEQ ID NO: 156701 - DNA, 3861 bp, Homo sapiens
  Payload ID: 10720
  Gene Symbol: MYBPC1
  Gene Name: myosin binding protein C, slow type
  Uniprot ID: Q00872
  ENST ID: ENST00000452455
  CDS Start-End: 103-3624
ttgtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctc

SEQ ID NO: 156702 - DNA, 3569 bp, Homo sapiens
  Payload ID: 10720
  Gene Symbol: MYBPC1
  Gene Name: myosin binding protein C, slow type
  Uniprot ID: Q00872
  ENST ID: ENST00000545503
  CDS Start-End: 76-3516
gcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaagg

SEQ ID NO: 156703 - DNA, 3533 bp, Homo sapiens
  Payload ID: 10720
  Gene Symbol: MYBPC1
  Gene Name: myosin binding protein C, slow type
  Uniprot ID: Q00872
  ENST ID: ENST00000541119
  CDS Start-End: 76-3480
gcctgcctgtggggtttctgtcaactagtcgtggagggaaggagactctttaaagaataacatcttattgtggccatgccagaacccactaagaaagaggaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaagg

SEQ ID NO: 156704 - DNA, 3512 bp, Homo sapiens
  Payload ID: 10720
  Gene Symbol: MYBPC1
  Gene Name: myosin binding protein C, slow type
  Uniprot ID: Q00872
  ENST ID: ENST00000536007
  CDS Start-End: 76-3459
gcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaagg

SEQ ID NO: 156705 - DNA, 3934 bp, Homo sapiens
  Payload ID: 10720
  Gene Symbol: MYBPC1
  Gene Name: myosin binding protein C, slow type
  ENST ID: ENST00000551300
  CDS Start-End: 543-3617
cctgcctgtggggtttctgtcaactagtcgtggagggaaggagactctttaaagaataacatcttattgtggccatgccagaacccactaagaaagaggcaatttcaaagtatccccgaatcaaacatgaatgttgaagtcaactacccagactgaagttgcttttaaaaaatgcttggacacaaaaacaaataaaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctc

SEQ ID NO: 156706 - DNA, 3749 bp, Homo sapiens
  Payload ID: 10720
  Gene Symbol: MYBPC1
  Gene Name: myosin binding protein C, slow type
  ENST ID: ENST00000547509
  CDS Start-End: 101-3499
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagaga

SEQ ID NO: 156707 - DNA, 661 bp, Homo sapiens
  Payload ID: 10720
  Gene Symbol: MYBPC1
  Gene Name: myosin binding protein C, slow type
  ENST ID: ENST00000550514
  CDS Start-End: 348-661
ctcttccaaataagctttccttgtggcttacgctgttcttcacttggatttgaacccgatcagcggctttcctttcaccaaaggatcttatttttgtaatttgtcggactttgcaagaattgtgatattctcagccagccctttcttcataagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggagga

SEQ ID NO: 156708 - DNA, 4031 bp, Homo sapiens
  Payload ID: 10720
  Gene Symbol: MYBPC1
  Gene Name: myosin binding protein C, slow type
  ENST ID: ENST00000549145
  CDS Start-End: 101-3565
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacata

SEQ ID NO: 156709 - DNA, 3777 bp, Homo sapiens
  Payload ID: 10720
  Gene Symbol: MYBPC1
  Gene Name: myosin binding protein C, slow type
  Uniprot ID: Q00872
  ENST ID: ENST00000553190
  CDS Start-End: 88-3459
gcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctca

SEQ ID NO: 156710 - DNA, 3834 bp, Homo sapiens
  Payload ID: 10720
  Gene Symbol: MYBPC1
  Gene Name: myosin binding protein C, slow type
  Uniprot ID: Q00872
  ENST ID: ENST00000547405
  CDS Start-End: 223-3585
agatgtgagaaaggtccccatagctgtcaagttcctgcatccttgtgctgaagaaagggaggtgccatcatgattgatgttcagaggcagtataaaagcactgggtttctccccaactgcttgtcacaccgacctgcaccatctctcgcctgcctgtggggtttctgtcaactagtcgtggagggaaggagactctttaaagaataacatcttattgtggccatgccagaacccactaagaaagaggactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagag

SEQ ID NO: 156711 - DNA, 3426 bp, Homo sapiens
  Payload ID: 10720
  Gene Symbol: MYBPC1
  Gene Name: myosin binding protein C, slow type
  Uniprot ID: Q00872
  ENST ID: ENST00000550270
  CDS Start-End: 1-3426
atgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataa

SEQ ID NO: 156712 - DNA, 1805 bp, Homo sapiens
  Payload ID: 10721
  Gene Symbol: MYBPH
  Gene Name: myosin binding protein H
  Uniprot ID: Q13203
  ENST ID: ENST00000255416
  CDS Start-End: 59-1492
aggccccccaacggctgacccctgcacactccaccctggccccccagccagtccagcaatgatggaaaaaaacacctccgagggccctgcctgcagtccagaggagaccgcatctgaatctgccaaggtgcccacagcagagcctcccggagaagtggcagtatcagagtccaccagagaagagcaggtgcccaagccgcaggcccctgccccacaggcccctacagcctccacagccactaagcctgcacccccaagtgaagatgtccccagtgccccactgctgctgaccctggatgatgtgagcagcagctctgtgactgtgagctgggagcccccagagaggctggggaggctgggcctccagggctatgtgctggagctctgcagagagggagcctcggagtgggtgcctgtgagtgcccggcccatgatggtgacccagcagactgtgcggaacctggctctgggagacaagttcctcctgcgcgtgtctgcagtgagttctgcaggggctggcccgccggccatgctggaccagcccatccacatccgagagaacattgaggcccccaagatccgtgtcccccgccacctccgtcagacctacatccgccaggtgggagagacggtcaacctgcaaatccccttccaggggaagcctaagcctcaggccacatggacccacaacggccatgccctggacagccagcgggtgagcatgcgcaccggggaccaggactccatcctcttcattcgctcggcccagcgctccgactctggccgctacgagctcactgtgcgcgtggaagacctggaggccaaggcagtcattgacatcctggtgattgagaaacctggaccccccagcagcatcaggctcctggacgtctggggctgcaatgctgctcttcagtggacgccaccccaggacacaggcaacacagagctcctgggctacatggtgcagaaggcagacaaaaagacagggcaatggttcacagtgctggagcgctaccacccaaccacctgcaccatctctgacctcatcatcggcaactcgtactccttccgggtcttctcagaaaacctgtgtggactcagcacctcggccaccgtcaccaaggagctcgcccacatccagaaggcagatattgctgccaaacctaaagggtttattgagcgagacttctcagaagccccctcattcacccagcccctggctgaccacacctccacccctggctacagcacccagttgttctgcagtgtccgagcttcacccaagcccaagatcatctggatgaaaaacaagatggagatccagggcaaccccaaataccgcgccctctctgagcaaggcgtctgcaccctagagatccggaaacccagcccctttgattctggggtctacacctgcaaggccataaatgtgctgggggaggcatctgtggactgccggctggaggtcaaagcctcagccgcacactgaagtcacgggaggaggctgtgatgaggagccaggtgctgcaggcctgaggggccaggtccaccaggcctacagtcaaactccagagatgcccaagacccccgcttccatagcgacggctgatggaaccgcccctggtacctgctggcctcccttccccagaggctggtgtccagaactcaggaatgggcctggtaggccccaggccagactaactgggctcaaggggtgctggaaggcgcagagattggagtgccctgcggagttgcactctgggtgggaagcactcaaataaagatgcgtggtgttaacagtg

SEQ ID NO: 156713 - DNA, 1772 bp, Homo sapiens
  Payload ID: 10721
  Gene Symbol: MYBPH
  Gene Name: myosin binding protein H
  ENST ID: ENST00000621380
  CDS Start-End: 29-1459
ccaccctggccccccagccagtccagcaatgatggaaaaaaacacctccgagggccctgcctgcagtccagaggagaccgcatctgaatctgccaaggtgcccacagcagagcctcccggagaagtggcagtatcagagtccaccagagaagagcaggtgcccaagccgcaggcccctgccccacaggcccctacagcctccacagccactaagcctgcacccccaagtgaagatgtccccagtgccccactgctgctgaccctggatgatgtgagcagcagctctgtgactgtgagctgggagcccccagagaggctggggaggctgggcctccagggctatgtgctggagctctgcagagagggagcctcggagtgggtgcctgtgagtgcccggcccatgatggtgacccagcagactgtgcggaacctggctctgggagacaagttcctcctgcgcgtgtctgcagtgagttctgcaggggctggcccgccggccatgctggaccagcccatccacatccgagagaacattgaggcccccaagatccgtgtcccccgccacctccgtcagacctacatccgccaggtgggagagacggtcaacctgcaaatccccttccaggggaagcctaagcctcaggccacatggacccacaacggccatgccctggacagccagcgggtgagcatgcgcaccggggaccaggactccatcctcttcattcgctcggcccagcgctccgactctggccgctacgagctcactgtgcgcgtggaagacctggaggccaaggcagtcattgacatcctggtgattgagaaacctggaccccccagcagcatcaggctcctggacgtctggggctgcaatgctgctcttcagtggacgccaccccaggacacaggcaacacagagctcctgggctacatggtgcagaaggcagacaaaaagacagggcaatggttcacagtgctggagcgctaccacccaaccacctgcaccatctctgacctcatcatcggcaactcgtactccttccgggtcttctcagaaaacctgtgtggactcagcacctcggccaccgtcaccaaggagctcgcccacatccagaaggcagatattgctgccaaacctaaagggtttattgagcgagacttctcagaagccccctcattcacccagcccctggctgaccacacctccacccctggctacagcacccagttgttctgcagtgtcgagcttcaccaagccaagatcatctggatgaaaaacaagatggagatccagggcaaccccaaataccgcgccctctctgagcaaggcgtctgcaccctagagatccggaaacccagcccctttgattctggggtctacacctgcaaggccataaatgtgctgggggaggcatctgtggactgccggctggaggtcaaagcctcagccgcacactgaagtcacgggaggaggctgtgatgaggagccaggtgctgcaggcctgaggggccaggtccaccaggcctacagtcaaactccagagatgcccaagacccccgcttccatagcgacggctgatggaaccgcccctggtacctgctggcctcccttccccagaggctggtgtccagaactcaggaatgggcctggtaggccccaggccagactaactgggctcaaggggtgctggaaggcgcagagattggagtgccctgcggagttgcactctgggtgggaagcactcaaataaagatgcgtggtgttaacagtg

SEQ ID NO: 156714 - DNA, 1372 bp, Homo sapiens
  Payload ID: 10722
  Gene Symbol: MYBPHL
  Gene Name: myosin binding protein H-like
  Uniprot ID: A2RUH7
  ENST ID: ENST00000357155
  CDS Start-End: 51-1115
accagcagtgaaaatctagagctggagctcagcctctgggaaggcccagcatggaggcagccacagctccggaggtggccgcaggatccaagctgaaggtgaaagaagccagcccagcggatgctgaaccaccccaggcttcacctggacagggggctggcagccccactccccagctcctgccccctatagaagagcaccccaagatctggctacctcgggccctgaggcagacctacatccggaaggttggggacacagtgaacctactaatcccattccagggcaagcccaaacctcaagccatctggacacatgatggctgtgccttggacaccaggcgtgtgagtgtgcggaatggggagcaagactccatcctcttcatccgagaagcccaacgtgctgactcaggtcgctaccaactccgcgtgcagctgggtgggctggaggccaccgccaccattgacatcctggtgattgagaggccaggccctcctcagagtattaagctggtggacgtttggggcttcagcgctacactggaatggacaccgccccaagatacggggaatacagcacttctgggatacacggtgcagaaggctgacacaaaatccgggctgtggttcacggtgctggagcactatcaccgcaccagctgcatcgtctctgacctcatcatcggcaactcctatgccttccgtgtctttgctgaaaaccagtgcggactcagtgaaacagcccccatcactacggacctcgcccacatccagaaagcagctactgtttacaagaccaaggggtttgcccaacgagacttctctgaagccccaaagtttacccagcctctggccgactgcactacagtcaccggctataatacccagctcttctgctgtgtccgcgcctctccccggcccaagatcatctggctgaagaacaagatggatatccaaggcaaccctaagtacagagccctgactcacctgggaatctgctccctagagatccgcaagccgggtccctttgatggaggcatctatacctgcaaggcggtgaaccccctaggggaggcatctgtggactgtcgggtggatgtgaaagttcctaattgaggacacctaagaaggcatggtactctgacaaagccagtgcccagcaatgaagtgaattcatggcacaggagccagggaccgtgacaacggtgccctcagcagcctggtgtcctctggccatttgctgtcatggctacaaagtgctccctcttttcagtgcctccaggaagcccgccagtggtgagactgtgtcctcaaggagcttcggcaccatgtctggtttggattcatctaaataaatatgtggttccccagtg

SEQ ID NO: 156715 - DNA, 3621 bp, Homo sapiens
  Payload ID: 10723
  Gene Symbol: MYO1A
  Gene Name: myosin IA
  Uniprot ID: Q9UBC5
  ENST ID: ENST00000300119
  CDS Start-End: 252-3383
gactggcacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaggacccttgtcccaaacccttcttgttctctcctccaaaagtagcttcctccaacccgcagcctctctgcacactaataaaacatgtggcttggaaaggttca

SEQ ID NO: 156716 - DNA, 3658 bp, Homo sapiens
  Payload ID: 10723
  Gene Symbol: MYO1A
  Gene Name: myosin IA
  Uniprot ID: Q9UBC5
  ENST ID: ENST00000442789
  CDS Start-End: 289-3420
aatgcaagggggagttcaatgaaactgggacatctatacacatgtgagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaggacccttgtcccaaacccttcttgttctctcctccaaaagtagcttcctccaacccgcagcctctctgcacactaataaaacatgtggcttggaaaggttca

SEQ ID NO: 156717 - DNA, 560 bp, Homo sapiens
  Payload ID: 10723
  Gene Symbol: MYO1A
  Gene Name: myosin IA
  ENST ID: ENST00000433964
  CDS Start-End: 272-560
gctgagagttggagaatcaagtctctcttcaggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgta

SEQ ID NO: 156718 - DNA, 3099 bp, Homo sapiens
  Payload ID: 10723
  Gene Symbol: MYO1A
  Gene Name: myosin IA
  ENST ID: ENST00000554234
  CDS Start-End: 319-2385
agtctgctccaagtagagagagtggatgaacctgcgtgctggagattgagtgaaagatggtgtcttgaactggtttcacaatagtcattgcccacttcctccccacaagctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaaggcaaaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagagg

SEQ ID NO: 156719 - DNA, 566 bp, Homo sapiens
  Payload ID: 10723
  Gene Symbol: MYO1A
  Gene Name: myosin IA
  ENST ID: ENST00000492945
  CDS Start-End: 346-566
agttttccattttaatggagtatctgtattgccttcctcggggtggtgctattcagtgaggcaatgcaagggggagttcaatgaaactgggacatctatacacatggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagt

SEQ ID NO: 156720 - DNA, 4933 bp, Homo sapiens
  Payload ID: 10724
  Gene Symbol: MYO1B
  Gene Name: myosin IB
  Uniprot ID: O43795
  ENST ID: ENST00000304164
  CDS Start-End: 94-3504
gccccgcagccccgggctgggcccgcgtcccggagcgccaccggagagcgaggacgacgtggaggcggagtggcgcccggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggcacgaagggaactgagacggctgaaggaggaggctaggaataaacatgctattgcagttatttgggcttactggcttggatctaaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 156721 - DNA, 5026 bp, Homo sapiens
  Payload ID: 10724
  Gene Symbol: MYO1B
  Gene Name: myosin IB
  Uniprot ID: O43795
  ENST ID: ENST00000339514
  CDS Start-End: 361-3597
ggtggctcccgttcctgcccgcgcgccgaggggcgaatcccaggcagcgaggtcgccgcccccgcccctcggccggcccctccgccagcgggcgagaggggagtggccgggctcctcccgccgccgctgagcactccgcagctgggtgcgcacgggagcctcaaccgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgaggtagcgccaggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 156722 - DNA, 4764 bp, Homo sapiens
  Payload ID: 10724
  Gene Symbol: MYO1B
  Gene Name: myosin IB
  ENST ID: ENST00000392316
  CDS Start-End: 12-3335
agctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 156723 - DNA, 5082 bp, Homo sapiens
  Payload ID: 10724
  Gene Symbol: MYO1B
  Gene Name: myosin IB
  Uniprot ID: O43795
  ENST ID: ENST00000392318
  CDS Start-End: 248-3658
cctcccgccgccgctgagcactccgcagctgggtgcgcacgggagcctcaaccgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgaggtagcgccaggcgagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggcacgaagggaactgagacggctgaaggaggaggctaggaataaacatgctattgcagttatttgggcttactggcttggatctaaggctcgaagggaattgaaacgcttgaaggaggaggctaggcgtaagcatgcagttgctgtcatttgggcttactggcttggactgaaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcag

SEQ ID NO: 156724 - DNA, 374 bp, Homo sapiens
  Payload ID: 10724
  Gene Symbol: MYO1B
  Gene Name: myosin IB
  ENST ID: ENST00000420448
  CDS Start-End: 124-374
ggaagttaacttttcttaatcgggtttctacaaggtagttcactattgtatgttttatttcttaccaaaacttttcttgggaaaatttgttttattgctccatacgtggtcaagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacat

SEQ ID NO: 156725 - DNA, 1310 bp, Homo sapiens
  Payload ID: 10724
  Gene Symbol: MYO1B
  Gene Name: myosin IB
  ENST ID: ENST00000451437
  CDS Start-End: 400-1310
tttcctcagttagattgcacatgcatgagaagcagtagatgtgtctctcattctttcttctttcattgcctgctaagtactgtttgtataccagtagcatgggtcagagtgggaggttgtcaacagaagagtccagcatgtatccatgatggactctcgatcaactttatatgattaactcatataaaacagccctgtatggaagctgaggctgcctcttcctagccacaggatattgacctactttccccttcttatctgcttgcaaaatatttgttgtacttagtgtgttctccctgtcacaacgaatgtttgtctctctctttcatatgaactgaaggctaaagtgctagttaaatcagtggaaaaagcaatggagaagaaaagttgctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaa

SEQ ID NO: 156726 - DNA, 542 bp, Homo sapiens
  Payload ID: 10724
  Gene Symbol: MYO1B
  Gene Name: myosin IB
  ENST ID: ENST00000438652
  CDS Start-End: 95-542
agagacgggagctacgaagggtggtggggccgggaagagagttggggagagggttgggagagggtgatgagagcgcgctggagagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctgg

SEQ ID NO: 156727 - DNA, 572 bp, Homo sapiens
  Payload ID: 10724
  Gene Symbol: MYO1B
  Gene Name: myosin IB
  ENST ID: ENST00000418908
  CDS Start-End: 83-572
aaacccgcaaggcgcggaggccgccgcgacgctcaccggggggcgctgtgaagccggcaccgggcggacagagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcct

SEQ ID NO: 156728 - DNA, 791 bp, Homo sapiens
  Payload ID: 10724
  Gene Symbol: MYO1B
  Gene Name: myosin IB
  ENST ID: ENST00000427152
  CDS Start-End: 1-577
gtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagtacgttcatgtattgtttgaaaaccctttttctctttcagcttttttgttttagttcagctctcgatctcattcattaatacaactacttattaagtaccaggtatgtgtctagtagttgttccacatgataaatgggcagtgaatgacactgaccaagtctccaacctcatgtacctgacatcctagtggaagagaccagtatgtacaaataaaatgatgaaatagttgataagattttggctaacaagtgtttatggaggaaaaaa

SEQ ID NO: 156729 - DNA, 567 bp, Homo sapiens
  Payload ID: 10724
  Gene Symbol: MYO1B
  Gene Name: myosin IB
  ENST ID: ENST00000634375
  CDS Start-End: 1-567
tggctaaaaacctctacagcaggttgttttcatggttggtaaatcgaatcaatgaaagcattaaggcacaaacaaaagtgagaaagaaggtcatgggtgttctggacatttatggctttgagattttcgagaatgcagacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgt

SEQ ID NO: 156730 - DNA, 5145 bp, Homo sapiens
  Payload ID: 10725
  Gene Symbol: MYO1C
  Gene Name: myosin IC
  Uniprot ID: O00159
  ENST ID: ENST00000359786
  CDS Start-End: 326-3517
ggagcccagggtcccccatgggtggctgcatcggctcctctggttacctgggacaacaggcatttcctccatccccagcccctcctcttcctgctccaaccatccgggccaagaggcctcccagtcagacctggacggctccagccgtgtcctgaggagctggaccagccacatcccctggggctgcagttgaagcagaaccaagtggccatcccggcgttagaccgtaggttcctggtcccggagtggtcggagcccgccagtgggcaggcagctcttgctcacaggccgcggtgcccaggccgctggctctccgcagggcggaatggcgctgcaagtggagctggtacccaccggggagatcatccgcgtggttcatccccacaggccctgcaagcttgccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccaatgtggtctccttatgaatattaggaaacgaagagggccccggaaggcaaccaagggcctcgtgttgcaggtttttctcgagacagtct

SEQ ID NO: 156731 - DNA, 4734 bp, Homo sapiens
  Payload ID: 10725
  Gene Symbol: MYO1C
  Gene Name: myosin IC
  Uniprot ID: O00159
  ENST ID: ENST00000361007
  CDS Start-End: 110-3196
agagtgcgcccgggccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgcc

SEQ ID NO: 156732 - DNA, 4898 bp, Homo sapiens
  Payload ID: 10725
  Gene Symbol: MYO1C
  Gene Name: myosin IC
  Uniprot ID: O00159
  ENST ID: ENST00000438665
  CDS Start-End: 224-3358
ggaccccccgccccgacacccccacctccaccaaccccacctggaggggaccccagcccggccgcgcgggaggcgggggaggccggggaagccccgcgcttcaggggcccgggtgggggcggtgcggggggcgggccctccctcgctgacgccgccgccaccgccgccgagcccgggacccggagcgcgggcagcggagcgggcgccaggccggccgggcaggatgcgctaccgggcgtcggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccaa

SEQ ID NO: 156733 - DNA, 3676 bp, Homo sapiens
  Payload ID: 10725
  Gene Symbol: MYO1C
  Gene Name: myosin IC
  ENST ID: ENST00000545534
  CDS Start-End: 244-3363
gcccccggccagaaatctgggcctttcgtggtcagaggacaccggcggcccctttgggatccacccccaatcaccaccaccttgttcttctctgaccctggatactctgggtgtccattttttggagccctgagaccctgtttgaagagggatccatctcagccctggttgtggggcgagggtcttgctcagcctgcaccaccctccaccctccagtaggacccagaggcagctgggctttccatggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatg

SEQ ID NO: 156734 - DNA, 541 bp, Homo sapiens
  Payload ID: 10725
  Gene Symbol: MYO1C
  Gene Name: myosin IC
  ENST ID: ENST00000571715
  CDS Start-End: 140-541
ccgaaacgttaagtgacttgctcagagtcccaccgcgaggaagaaccagcccagccttttgcagactctagacgtccccgcccctgcccgcggtgggatctgagccaaggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgcc

SEQ ID NO: 156735 - DNA, 4804 bp, Homo sapiens
  Payload ID: 10725
  Gene Symbol: MYO1C
  Gene Name: myosin IC
  Uniprot ID: O00159
  ENST ID: ENST00000575158
  CDS Start-End: 178-3264
gtatttggacattggttctatttttaactttcccgggactcgagttcgggggttgggggaggaaaatcccgcttcctctgggacccgcaggcctcggtgcccgcccagcgcccaggcccgccgcggagtgtagtcccaggcccggaagccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctgaggcggcagctgccccagaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccaa

SEQ ID NO: 156736 - DNA, 901 bp, Homo sapiens
  Payload ID: 10725
  Gene Symbol: MYO1C
  Gene Name: myosin IC
  ENST ID: ENST00000570984
  CDS Start-End: 101-901
ccgggccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggag

SEQ ID NO: 156737 - DNA, 385 bp, Homo sapiens
  Payload ID: 10725
  Gene Symbol: MYO1C
  Gene Name: myosin IC
  ENST ID: ENST00000575011
  CDS Start-End: 1-196
cacagaggatgccctggaggtccggcggcagagcctggccactctcccattcatgccactcgtggagcgcacacggcaccaggctcccagctggctccccgcgctctggccaattgcctttctttcccaaccgcagccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcgtcctgcgccacgccccccgctgccccgagaacgccttcttcctggaccatgtgcgcacctcttttttgctaaacctga

SEQ ID NO: 156738 - DNA, 753 bp, Homo sapiens
  Payload ID: 10725
  Gene Symbol: MYO1C
  Gene Name: myosin IC
  ENST ID: ENST00000575335
  CDS Start-End: 341-753
cgagtgtgacgggcggggggctccggggtggccggagaaggaggatggccacgcggccctcagtcctcacgctccggcctcccgcgcacacgcctggctctgagattcattcattcatccaggggtccgggaaggggtgactgagccccaccgtgtgcctcgctgcgtgtagggagtgggagccgtctcctgggagggactgacaaggaaacagctgattcctgcggggtgcgataaggaggcgctgcgtgtttgggagaatcaggaaggggttctggaggaggtgacacctgagccgagtctcagtgaggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccg

SEQ ID NO: 156739 - DNA, 583 bp, Homo sapiens
  Payload ID: 10725
  Gene Symbol: MYO1C
  Gene Name: myosin IC
  ENST ID: ENST00000573853
  CDS Start-End: 73-583
gcagagccaagcgagggaggttctgccgaggccgcttcggaggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagt

SEQ ID NO: 156740 - DNA, 555 bp, Homo sapiens
  Payload ID: 10725
  Gene Symbol: MYO1C
  Gene Name: myosin IC
  ENST ID: ENST00000574790
  CDS Start-End: 62-555
caagactcagaacagaaggacggtgtgggaggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaa

SEQ ID NO: 156741 - DNA, 565 bp, Homo sapiens
  Payload ID: 10725
  Gene Symbol: MYO1C
  Gene Name: myosin IC
  ENST ID: ENST00000570490
  CDS Start-End: 60-565
cctttctccacccaaaaccagcacctcccgggttctgccctctggtcctgcctgcgtccatgccctgtgccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccg

SEQ ID NO: 156742 - DNA, 5563 bp, Homo sapiens
  Payload ID: 10726
  Gene Symbol: MYO1D
  Gene Name: myosin ID
  Uniprot ID: O94832
  ENST ID: ENST00000318217
  CDS Start-End: 306-3326
aggctggaggcgggaccagccgctgccgtctccgtctcggtgtcccggcccctacagcgcccggcagccgcggcgggaggagcggaaactgtcgggtgcgtcccgttcggagccgcgccggccgagaaggcgccgaggagcagcgaggcggcctctgtccggcccggacccgccgagcggcgtgcgcgccccctccccgtagcctcgcggcgcggcctcgccccggcccctcccgagctcatcgcgggcccacggagcggccccggaggcccgagcgcgcccacctgagcccccgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccactctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaaccctttctcattctccaagcctggtcagctgcctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatcttatttttaaaggtgttctgcttatctgtcactgaaaacttggtgaaatttttgcttaaataaagtcaaccattatctgggaggatagaa

SEQ ID NO: 156743 - DNA, 1916 bp, Homo sapiens
  Payload ID: 10726
  Gene Symbol: MYO1D
  Gene Name: myosin ID
  ENST ID: ENST00000583621
  CDS Start-End: 306-1616
aggctggaggcgggaccagccgctgccgtctccgtctcggtgtcccggcccctacagcgcccggcagccgcggcgggaggagcggaaactgtcgggtgcgtcccgttcggagccgcgccggccgagaaggcgccgaggagcagcgaggcggcctctgtccggcccggacccgccgagcggcgtgcgcgccccctccccgtagcctcgcggcgcggcctcgccccggcccctcccgagctcatcgcgggcccacggagcggccccggaggcccgagcgcgcccacctgagcccccgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatgtgggattgctataatttgatagactgccttgttgatgcccagaacatcctgagttagaaccagtaaacctgttttcactttatggctgctaccacgtggacttactggtttatatctgtctgttaggtttagcatactttattaagttataccttaaattggctgaactttgcttcagaatctagtttcttcttccctttttcctcctttttctcctcttctactttgtagactatatggtattttattgtcttcagttaatgttgtttatattctctgaaacctacacattaaaatacttgttttactttgca

SEQ ID NO: 156744 - DNA, 3500 bp, Homo sapiens
  Payload ID: 10726
  Gene Symbol: MYO1D
  Gene Name: myosin ID
  ENST ID: ENST00000579584
  CDS Start-End: 273-3158
gtctcggtgtcccggcccctacagcgcccggcagccgcggcgggaggagcggaaactgtcgggtgcgtcccgttcggagccgcgccggccgagaaggcgccgaggagcagcgaggcggcctctgtccggcccggacccgccgagcggcgtgcgcgccccctccccgtagcctcgcggcgcggcctcgccccggcccctcccgagctcatcgcgggcccacggagcggccccggaggcccgagcgcgcccacctgagcccccgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagaaaccatctgcttatactctgaataaaattcaagaaagcatagattctacataaacaggcccaagattacatggcaaactgagatgaagaggatgctggctgagaaacaaacaaaagtgttcaattatttgaatgaagtaaggaaagatattttaaaatgtaaatcaacattaaaatctgaaaatggcacagttgatattgcagaaaatagaattgatgtgaaaggaaagtttgaagtctctcagtgtgcagaatttactgttataatgggcaacatgttaactttcttagcaatatacaaaataagggtacatcttacagagaaggcatcttatattcaataaaatatggtaatttaaaacat

SEQ ID NO: 156745 - DNA, 558 bp, Homo sapiens
  Payload ID: 10726
  Gene Symbol: MYO1D
  Gene Name: myosin ID
  ENST ID: ENST00000577252
  CDS Start-End: 1-135
aaacacgcccatttttccagccgaaagctctgtgcctcagacaaaattctggagtttgatcgagattttcgaattcgacattatgcaggcgatgtagtttcttcttggaatcttttatcctaccctcaacactgagtgaaccttaggcaagtcacttgacctccctacggatgagactgttagttcctgtatgttgctgttttgcttttatcttaggaatgctggatgataaatacagctatcttttaaaaagtcatcttcttgagctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagta

SEQ ID NO: 156746 - DNA, 5451 bp, Homo sapiens
  Payload ID: 10726
  Gene Symbol: MYO1D
  Gene Name: myosin ID
  ENST ID: ENST00000394649
  CDS Start-End: 545-3301
ttcttcaacttcttgatttaccctaggctggggttcccaaatccagctttgtgtcatgatcacccagcttttaaaatacgcagattccccggactctgtcttctggagatggtgatttattaagcctccttagtgcccagctcaaatgaagaaatattgcaccagaagaagaaagccaagaaatgaagtcacaacgtcagtcatttaatccaccacctgtggtcctaactagttcttatgtcctgtggaacacacagtctaacaaggggataaaactaattgactccatcacatggaaaccatgatttttgccaagagaagcagaaacaagatgctttcacccttgggagagattctcatctaagaactggcaagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccactctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaaccctttctcattctccaagcctggtcagctgcctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatctta

SEQ ID NO: 156747 - DNA, 8673 bp, Homo sapiens
  Payload ID: 10727
  Gene Symbol: MYO1E
  Gene Name: myosin IE
  Uniprot ID: Q12965
  ENST ID: ENST00000288235
  CDS Start-End: 401-3727
atttatggacagattgcccggcccgagccgagactcagccagaggagtacggattaagtggccgaagaaagaggagtgaggcaggggagcgaggcggacgctccgagcgcatcggactcacctgggccggcggcgaccggcgagtacgagtggactcttgccctccgcagcatgcgccccgcctgctaagtcgccgccgtctcgccctcacctagcaccgccaatcccgcctggatggagtcccctctgggttcccattggctcctgtgagtgcttgggtgtcgggagcctgtttttggcgaggggaaccaacttttgaagttcgcccagaagactgcgttccagccccagttccccggcagcgggacccggcgaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagtggtgaaagtggtgctggaaaaacagtggctgccaaatatatcatgagctacatctccagagtgtctggaggagggaccaaagtccagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcgccacgatgcatgcggtgggtgagggggcagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcagggtaaagcatcaagtcgaatatttgggtctgaaagagaacattcgagtgagaagagctggctatgcctatcggcgcatcttccaaaaattcctacagaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcagggggctcccggcaagtgcagttccaccaagggtttggggacctggctgtcctcaagcccagtaacaaagtgctgcaggtcagcatcggacctggactgcccaagaactcccgtcctaccagaaggaacactacccaaaatacaggttattccagtgggactcaaaatgccaactacccagtgagagctgcccctcctcccccaggataccatcagaacggagtcatcagaaaccagtatgtgccatatccccatgctcctggaagccagaggtccaatcagaaaagcctgtacacctccatggcccgcccgcccttgcctcggcagcagtctaccagttcagaccgagtgtcacagacgccagagagcctggatttcctcaaggtcccggaccagggagctgcaggggtcaggagacaaacaaccagtcggcctcccccagcagggggcagacccaagccccagcccaagcccaagcctcaggtgccacagtgcaaggctttgtatgcctatgacgctcaggacacagacgaactcagctttaatgccaatgacattattgatattatcaaagaagatccttctggctggtggacgggtcgactacgaggcaagcagggcctgttccccaacaactatgtgaccaagatctgaggtgcccgtgactctgacacatggggcagaggagctccaggcacagaccaggggaggggatatttaggggctccccttacaatccacaatgagcaattgcttctccaaggcctggagctattctggtaccttccccatggaggacactgaaaaggctgggttggggacagggagtatcactccataagtgatcctaaaaggtagcctcttcataggaacccaggaggacaaaaccaccatgcattaagatttatttattgtatttaaacctggtgagaggacaagtgaggtctgctcagaccttgtaggcttctatcaaaacagcaccctgcttgctcaccaggcctagagaatggctgtaggtggccgctgacaagtgcctttagttgaagagcacatttctttcatctctcttgtccatacctgatagacacattcctctctgccaccttccttcagggaggacccgccctctgcagactgggcttagcgtgagcaggcacttcccatgtacgtgccaagggtaagctggcctgctgagcccagggcgacagaggggcactggtttacactttgccgggaccatcagggccgccaagcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctaggtcagtccctgcagactcttctcaactctttccctataggaaacttactccgcgtcctgcccccacctcctaaataaataaaggaatcggcgaacaccttcttcttttatgacatttgttatgggttgaattgtgtgcctccaaagaagatgttggagtcccagccaccagtacctcacaatatgaccttatttggaaatagagtctttatggagcaaacaaacaaaactaattaaaatgaagtcattagagtgggtcttaatccaatataatggtgtcctgatgaaaaggggaaatttggacacagagaccaacatgccagaggaaagaccatgtgaaaaggcagggagaagacagccattcacaagccctggacagaggcctggaacagattctccctcacaccctcacaaggaaccagccctgcccaccttggtcttggacttccaacctccagaactgtgaggcaatacatttcgctgtttaagccactcggtttgtggtagtttgttacggcagccctaacaaactaaaacaatgttttcttgccataatagtgaaaagctggaatcagtgtaatgcccatcaataatggaatggttgtaagtagagactgccatttctctacctttcctcctctgggtgccatagccattcttaagctactggtaacttagagtttgagcagcatacacctttgaggctttcaggatcctcaagtccatgggaaaaaattatcagggcttacgtataagggaaaaaaattgatctagatttgaaacgaagatacatttaattctgctgtgttttacttcaagaacagggagcaaactccattctgtaacagtaacgaataatgttaaaaggctacttcagttccatgttgcgaccagagaggaaagtagagccatgatgcggtgagttgaggaaaggtaatcctgttgacactagtggtctctaaagtactttcacattcatggactccccgcagtgggaggaagataccaccagaactgggacagaggagcatgctggagtccccacagccaccagcactcaggctgcgttctcagggcaggaacaccaggaccatcttcccttgttatcataagcccctggctggctgggacaagcctttgtttttcctcctgattgattgattggcattttacacttgtgtgtaactgggaaccatcgggctctaggtcacaaaacagggactgagttaaacccccacgagtaacaccctcatccatggaaatcacagaccaagcccttagcacctgcatcgtgtgcccagccagtgccaggctcaaggagatgcccaacaaatggtgctgaaataggtaagtgacccacaggggaaggagacttagatctgcgtagagatgctgaaatgctgacactattaagaaaagtttggagaaatagtggtttatcttaaacttatttgtatatatttagaaattcaacatggggactaccagaaaaatctgggataaataacatttccctttttttcctaattaaaaagtcttcagaaaaatgtcttttttccctttaagacactaacctgggtttcctctagtctgtggatctagcctggcctgccattttgttcactgtgcagttaagcaaatatgaccactttaggagtcacttaccaggaaagaacatacagaagatcaaggggccacccccaccttctggaacttgccatcctgtttgaaataaggggtgttcatgtgcacacacagcaacgtgtatagcagtatcaaacacagtataaaaatgtgacatcccttcaaccaaaggttttaagtaaccaggaactaaatgagaaggcctgactgtgtaccctagggtagaggtgttcaagctttagttgtagaagagagagagacagaggtctgtataagggtggtatccactctactgatggccgtctgtgagacagagagaggctgatctgaaactcctgggatcaaacgatcctcctgcctcagcctctcaaagtgctgggattatgggcaagagccaccgtacctggccaactggcttaaagacatgcaaaagggccgtctcttccacagtgttttgtgaaacaatacagagacatgtggagaggacaaagggtgaagccttcttgaataagcttgctccccaaccatgaaggatgccaacccactgacctcccaacgtgtggtcccagcccatcgtaatcaaacctgactccccactactaccaagtccagcccaatgaaggtagaaaagcatcgtgcagtttcctccttaaaggacctgccctgtgtgcacaccatgtccaccaatattctgctggccagagcttagtcatgtggcctcaactcaagggggctggaggtctctgcacagagctgtctcagcagcttacccagagcaccagagtgacagcgggctcctgccaggtggaagtgttcacaaaaatgagtaagagaaaatatggatgtgcctttatgaattacaaactccatgggcttccatagagcatggcttttacataatctaaattccttctctttgcgactccctcctgaactcatccccagaccctccctgagtggagctggtcacaccaagtcagcctgtgcctctagttgctaccatttcttttataggtgttgtcccagttaagatttcactggcagtagggctggattctggtttccagggcaatcaagagcagagcatgaacggtgcgtctttggtagacaatttaactctgtgtttctggcacccctcacttttgtgatcaaaagaaagaccagaggagcctttctgcaattctgccctctttccctgttttgcttttctcccaaggcctagctgattgattgcagttctttctggatttagtaacttggttttattcctacccactaatcttgatgtctttttccctactagatcatacctttccactctgagcaccctttctaacaagaagactggctcagtatggttcactaggtcgcccaaggtcacacagttcttccctgggggagccatcacaggaactctgagtcaaaggcctgtgcgtttttattttcagacagcacctcactttgtcacccagactagagaacagtggtgcgatcatgccttactgcagtctcaaactccagggctcaggtgatcctcccacctcagcctcccaagtagctgggaccacaagcatgtgccaccacattcggctaattatttgtacagatggggtctccctgtgttgcccagctggtctcaaagctctgggctcaagcagtcttcccgccttggcctcccaaaattctgggattacaagcatgagccactgtgcccaaaaggcctgtgcttttaatcattttctccaattcaacagatatttagtaatgtgatggtctactgtgtcagcctttcaacttccaatatcttcctctcagaacataaaagtctatttaaaaagagagagagaagaaaactcacgcataaaactcaacagctagaaacttgtaagctcctttaatgggcaggagctccatctaacaaatctgaatcctctgattcatctctttccaagaccattaaccttctctttaaaataattaacagctatgttcaagtatcttcttcacactagaagctatactaagtgcttggcatactttacttagcaccaccctatgagggagacactcttatccccacttcacaggtacagaaactaaagtatagagatcaccactacttaaaatcaaacccaaagcacccacgttcagagttagtgctcttctatactatggatacatcatctcatttttaatttccgtgtttttatgatatggtttctacttctgccactcatttcccatttatgacattttagtttggggtgcctgctgtgccatctaagaaagtatcttaaaggtctttttttatgacatcctggaagaatttcctaagtcaggacatttaatatttaactaagtaaaatatgtaataaggaagcta

SEQ ID NO: 156748 - DNA, 562 bp, Homo sapiens
  Payload ID: 10727
  Gene Symbol: MYO1E
  Gene Name: myosin IE
  ENST ID: ENST00000559489
  CDS Start-End: 1-562
ataaaacaattgggaaaaacaaaggagatggatgtgtatgggattactgataagcagccttcactagaacttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagattccatcaataaagccatggagaaagaccatgaagaatacaacattggcgtcctagacatctatggctttgaaatattccagaaaaatggctttgaacagttttgtatcaattttgttaatgaaaaactgcagcagatttttattgaactgacattaaaggcagaacaggaagaatatgttcaagagggaataagatggacacccattgagtactttaataataaaatcgtatgtgacctcatagagaacaaagtgaaccctcctggcatcatgagcatcctggatgacgtgtgcg

SEQ ID NO: 156749 - DNA, 828 bp, Homo sapiens
  Payload ID: 10727
  Gene Symbol: MYO1E
  Gene Name: myosin IE
  ENST ID: ENST00000559269
  CDS Start-End: 1-828
ggaaaatactttgaaatccagttcagtccaggtggggaaccagatggtggaaagatctccaacttccttctggaaaaatctagggtggtgatgaggaacccaggagagcggagttttcacatattttaccagctcatcgagggcgcctctgcagagcagaaacacagccttggcatcaccagcatggactattattactacctgagcctctcgggctcatacaaggttgatgacattgacgacaggcgggagtttcaggaaactctgcacgccatgaatgtgattgggatctttgcagaagagcaaacgctggtgttgcagatagtggcgggtattctccacctgggaaacatcagcttcaaagaagttggcaactacgcggctgtggagagtgaagagtttttagcttttcctgcatatctgctagggataaaccaggaccggttgaaagaaaagctaacaagccggcagatggatagcaagtggggaggcaaatccgaatccatccacgtgaccctcaacgtagagcaggcctgttacacccgggatgcgctcgccaaggccctgcacgcccgggtctttgatttcttggtagatggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcagtactatgcaggatgacatttttattctccatgagcaagagtatgacagtttgcttgaatctgtcttcaaaactgaattcctaagc

SEQ ID NO: 156750 - DNA, 557 bp, Homo sapiens
  Payload ID: 10727
  Gene Symbol: MYO1E
  Gene Name: myosin IE
  ENST ID: ENST00000558571
  CDS Start-End: 28-366
gaagacgcgaccgcggcgcgagtcaccatgggaagcaaaggtgtctaccagtaccactggcaaagccacaatgtcaagcacagtggtgtggacgacatggtgctactgtccaagatcacagagaactccatcgtggagaatctgaagaagagatacatggatgactacatttttacatatataggatctgtattaatctcagtcaaccctttcaagcagatgccatattttggggaaaaggaaattgaaatgtaccaaggagcggcacagtatgaaaacccaccacatatctatgcccttgcagataatatgtacagaaacatgatcattgacagagagaaccagtgcgtcattatcagcacgtgaaggacattatcctgcagtccaacccgctgctggaggccttcgggaacgccaagaccgtccggaacaacaactccagccgatttggaaaatactttgaaatccagttcagtccaggtggggaaccagatggtggaaagatctccaacttccttctggaaaaatctagggtggtgatgaggaacccaggagag

SEQ ID NO: 156751 - DNA, 541 bp, Homo sapiens
  Payload ID: 10727
  Gene Symbol: MYO1E
  Gene Name: myosin IE
  ENST ID: ENST00000559412
  CDS Start-End: 1-222
cagacgccagagagcctggatttcctcaaggtcccggaccagggagctgcaggggtcaggagacaaacaaccagtcggcctcccccagcagggggcagacccaagccccagcccaagcccaagcctcaggtcaggggctgggggctgggggctgggctgctggctttgctttctctgggtcttcaattagaatgtggctggcccatattggtttgtgtttaaatgctgtacttactacaagaaggatcttttttcaagctgtacatttataaaaacagatcatatactgtatatataaaaatcttgagatggtagaaacatgtatgaatgtactaagtagtattccactgtactcattcataaggtaggttttcttacaaaactcacaccaggtacttaaagatgtgctctgcttttttccaactacggagtgtcactgctttctaggtcagtccctgcagactcttctcaactctttccctataggaaacttactccgcgtcctgcccccacctcctaaataaataaaggaatcggcgaa

SEQ ID NO: 156752 - DNA, 952 bp, Homo sapiens
  Payload ID: 10727
  Gene Symbol: MYO1E
  Gene Name: myosin IE
  ENST ID: ENST00000560749
  CDS Start-End: 1-952
cagatcagacgctgctccagaaacttcagatgcagattgggagtcatgagcacttcaacagttggaaccaaggcttcatcattcatcattatgctgggaaggtatcctatgacatggatggcttttgtgaaaggaaccgggatgtgctttttatggatctcatcgagcttatgcagagcagcgagctgcctttcataaagtctttatttccggaaaatctgcaggctgacaagaaagggcgcccaactactgccggaagcaaaataaagaaacaagccaatgaccttgtgagcaccctgatgaaatgtacgccccactacattcgctgcatcaagccaaacgaaaccaagaagcccagagactgggaggaaagcaggtatgccattctgaccaaagccacctggccttcttggcagggagaggagaagcaaggcgtcctgcacctgctgcagtcggtcaacatggacagcgaccagttccagctggggaggagtaaagtgttcatcaaagcccccgagtctctatttcttttagaagagatgagagagagaaagtatgatgggtatgctcgagtgatacagaaatcatggaggaaattcgtggcccggaagaaatacgttcaaatgagagaagaagcctcagacctcttattgaacaagaaggagagaaggagaaacagtattaacaggaactttataggggattatattgggatggaagagcacccagaactccagcagttcgtgggcaagagggagaagattgatttcgcagacacagtcaccaagtatgacaggaggttcaagggtgtaaagcgagacctgctccttaccccaaagtgcttgtacttaatcggacgagaaaaagtcaaacagggcccagacaagggcctggtgaaagaagtcctgaagcggaaaatcgagatagaacggatcttgtctgtgtccctcag

SEQ ID NO: 156753 - DNA, 4303 bp, Homo sapiens
  Payload ID: 10728
  Gene Symbol: MYO1F
  Gene Name: myosin IF
  Uniprot ID: O00160
  ENST ID: ENST00000338257
  CDS Start-End: 269-3565
atcaagttctgacccctcccttcaggctcagagccccaaacagccagctccccgcccccctccacacccagcttccctcccccatggcctcggcccctcccgccaaaggaagtgagaaggggctgttgtaagaggaactaaagccgggagtccggtgaacgggcagaagcagggccatgcccaagccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatcgacctctatcagggcgcggcccagtatgagaatcccccgcacatctacgccctcacggacaacatgtaccggaacatgcttatcgactgtgagaaccagtgtgtcatcattagtggagagagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatgggggcaagatctccaacttcttgctggagaagtcccgcgtggtcatgcaaaatgaaaatgagaggaacttccacatctactaccagctgctggaaggggcctcccaggagcaaaggcagaacctgggcctcatgacaccggactactattactacctcaaccaatcggacacctaccaggtggacggcacggacgacagaagcgactttggtgagactctgagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactacgctggcaaggtctcctacgacgtcagcggcttctgcgagaggaaccgagacgttctcttctccgacctcatagagctgatgcagaccagtgagcaggccttcctccggatgctcttccccgagaagctggatggagacaagaaggggcgccccagcaccgccggctccaagatcaagaaacaagccaacgacctggtggccacactgatgaggtgcacaccccactacatccgctgcatcaaacccaacgagaccaagaggccccgagactgggaggagaacagagtcaagcaccaggtggaatacctgggcctgaaggagaacatcagggtgcgcagagccggcttcgcctaccgccgccagttcgccaaattcctgcagaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcgcttttcctcctggaggaggtgcgagagcgaaagttcgatggctttgcccgaaccatccagaaggcctggcggcgccacgtggctgtccggaagtacgaggagatgcgggaggaagcttccaacatcctgctgaacaagaaggagcggaggcgcaacagcatcaatcggaacttcgtcggggactacctggggctggaggagcggcccgagctgcgtcagttcctgggcaagagggagcgggtggacttcgccgattcggtcaccaagtacgaccgccgcttcaagcccatcaagcgggacttgatcctgacgcccaagtgtgtgtatgtgattgggcgagagaaagtgaagaagggacctgagaagggccaggtgtgtgaagtcttgaagaagaaagtggacatccaggctctgcggggagtctccctcagcacgcgacaggacgacttcttcatcctccaagaggatgccgccgacagcttcctggagagcgtcttcaagaccgagtttgtcagccttctgtgcaagcgcttcgaggaggcgacgcggaggcccctgcccctcaccttcagcgacacactacagtttcgggtgaagaaggagggctggggcggtggcggcacccgcagcgtcaccttctcccgcggcttcggcgacttggcagtgctcaaggttggcggtcggaccctcacggtcagcgtgggcgatgggctgcccaagagctccaagcctacgcggaagggaatggccaagggaaaacctcggaggtcgtcccaagcccctacccgggcggcccctgcgccccccagaggcatggatcgcaatggggtgcccccctctgccagagggggccccctgcccctggagatcatgtctggagggggcacccacaggcctccccggggccctccgtccacatccctgggagccagcagacgaccccgggcacgtccgccctcagagcacaacacagaattcctcaacgtgcctgaccagggcatggccggcatgcagaggaagcgcagcgtggggcaacggccagtgcctggtgtgggccgacccaagccccagcctcggacacatggtcccaggtgccgggccctataccagtacgtgggccaagatgtggacgagctgagcttcaacgtgaacgaggtcattgagatcctcatggaagatccctcgggctggtggaagggccggcttcacggccaggagggccttttcccaggaaactacgtggagaagatctgagctgggccctgggatactgccttctctttcgcccgcctatctgcctgccggcctggtggggagccaggccctgccaatgagagcctcgtttacctgggctgcaatagcctaaaagtccagtcctttggcctccagtcctgcccaggccctgggtcaccaggtcactgctgcagcccccgcccctgggccctggtcttcctccaacatcacacctgctgcccattctccatttctgtgtgtgtcaaaggggactaacagcagaatctacctcccaactgccatgtgattaagaaatgggtcttgagtcctgtgctgttggcaaagtgccaggcacagttggggaggggggggtccttaacaagcgtgactttgctcattctgtcatcactaaggcaataaacctttgccaggtgaaagcacgagttaacttactaagtgcccaacaaggacgatgttttcacagccctgtgaggtaggagctgtgaaggaccccatcttacaggtggaacaatggaggttcagagaggttcactgacccaagactgcacagagccatgccttgcattcatatgtgaccataaagcttgaatttgtcccagtttgggctgggcgcagtggctcacgcctgtaatcccagcactttgggaggctgaggcgggcagatcacgtgagaccaggagttcaagaccagcctggataacacagcaaaaccctgtttctactaaaaatttaaaaaag

SEQ ID NO: 156754 - DNA, 1254 bp, Homo sapiens
  Payload ID: 10728
  Gene Symbol: MYO1F
  Gene Name: myosin IF
  ENST ID: ENST00000598005
  CDS Start-End: 1-888
ccgagacgttctcttctccgacctcatagagctgatgcagaccaggccttcctccggatgctcttccccgagaagctggatggagacaagaaggggcgccccagcaccgccggctccaagatcaagaaacaagccaacgacctggtggccacactgatgaggtgcacaccccactacatccgctgcatcaaacccaacgagaccaagaggccccgagactgggaggagaacaggactggtgactccccaccccgaggggactcagcctaccctccccaccagagtcaagcaccaggtggaatacctgggcctgaaggagaacatcagggtgcgcagagccggcttcgcctaccgccgccagttcgccaaattcctgcagaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcgcttttcctcctggaggaggtgcgagagcgaaagttcgatggctttgcccgaaccatccagaaggcctggcggcgccacgtggctgtccggaagtacgaggagatgcgggaggaagcttccaacatcctgctgaacaagaaggagcggaggcgcaacagcatcaatcggaacttcgtcggggactacctggggctggaggagcggcccgagctgcgtcagttcctgggcaagagggagcgggtggacttcgccgattcggtcaccaagtacgaccgccgcttcaagcccatcaagcgggacttgatcctgacgcccaagtgtgtgtatgtgattgggcgagagaaagtgaagaagggacctgagaagggccaggtgtgtgaagtcttgaagaagaaagtggacatccaggctctgcggggagtctccctcagcacgcgacaggacgacttcttcatcctccaagaggatgccgccgacagcttcctggagagcgtcttcaagaccgagtttgtcagccttctgtgcaagcgcttcgaggaggcgacgcggaggcccctgcccctcaccttcagcgacacactacagtttcgggtgaagaaggagggctggggcggtggcggcacccgcagcgtcaccttctcccgcggcttcggcgacttggcagtgctcaaggttggcggtcggaccctcacggtcagcgtgggcgatgggctgcccaagagctccag

SEQ ID NO: 156755 - DNA, 676 bp, Homo sapiens
  Payload ID: 10728
  Gene Symbol: MYO1F
  Gene Name: myosin IF
  ENST ID: ENST00000602136
  CDS Start-End: 1-357
aaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactacgctggcaaggtctcctacgacgtcagcggcttctgcgagaggaaccgagacgttctcttctccgacctcatagagctgatgcagaccagtgagcagtgagtggtcccaggcatggggacctccggctacaaccccccaaggggatggagggaggaccgggccccactccatcttacccagaactgccatctcgccacaaactcgaggggagtggctgtgcggccaggatggtgtttctatggactagttctgatgtaaaaagtaactccagagtgctgggattacaggcatgcaccaccgcacccggccttattaaccattttaaaatgtacaatttatccgtgttgttccctttttgtgacaaagaaaaaataaaggaaataaataaataaataaaataagataaaatgaaatgaaa

SEQ ID NO: 156756 - DNA, 582 bp, Homo sapiens
  Payload ID: 10728
  Gene Symbol: MYO1F
  Gene Name: myosin IF
  ENST ID: ENST00000598321
  CDS Start-End: 130-360
aaagccgggagtccggtgaacgggcagaagcagggccatgcccaagccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcgtaccctgggccaaggctggggacctacatcggctctgtgctcatctctgtaaaccccttcaagcagatgccctacttcaccgaccgtgagatcgacctctatcagggcgcggcccagtatgagaatcccccgcacatctacgccctcacggacaacatgtaccggaacatgcttatcgactgtgagaaccagtgtgtcatcattagtggagagagtggagctgggaagacagtggcagccaaatatatcatgggctacatctccaaggtgtctggcggaggcgagaaggtccagcacgtcaaagatatcat

SEQ ID NO: 156757 - DNA, 531 bp, Homo sapiens
  Payload ID: 10728
  Gene Symbol: MYO1F
  Gene Name: myosin IF
  ENST ID: ENST00000596675
  CDS Start-End: 130-531
aaagccgggagtccggtgaacgggcagaagcagggccatgcccaagccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcgtaccctgggccaaggctgggggtgggcagcagatgccctacttcaccgaccgtgagatcgacctctatcagggcgcggcccagtatgagaatcccccgcacatctacgccctcacggacaacatgtaccggaacatgcttatcgactgtgagaaccagtgtgtcatcattagtggagagagtggagctgggaagacagtggcagccaaatatatcatgggctacatctccaaggtgtctggcggaggcgagaaggtccag

SEQ ID NO: 156758 - DNA, 4296 bp, Homo sapiens
  Payload ID: 10728
  Gene Symbol: MYO1F
  Gene Name: myosin IF
  Uniprot ID: O00160
  ENST ID: ENST00000613525
  CDS Start-End: 269-3565
atcaagttctgacccctcccttcaggctcagagccccaaacagccagctccccgcccccctccacacccagcttccctcccccatggcctcggcccctcccgccaaaggaagtgagaaggggctgttgtaagaggaactaaagccgggagtccggtgaacgggcagaagcagggccatgcccaagccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatcgacctctatcagggcgcggcccagtatgagaatcccccgcacatctacgccctcacggacaacatgtaccggaacatgcttatcgactgtgagaaccagtgtgtcatcattagtggagagagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatgggggcaagatctccaacttcttgctggagaagtcccgcgtggtcatgcaaaatgaaaatgagaggaacttccacatctactaccagctgctggaaggggcctcccaggagcaaaggcagaacctgggcctcatgacaccggactactattactacctcaaccaatcggacacctaccaggtggacggcacggacgacagaagcgactttggtgagactctgagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactacgctggcaaggtctcctacgacgtcagcggcttctgcgagaggaaccgagacgttctcttctccgacctcatagagctgatgcagaccagtgagcaggccttcctccggatgctcttccccgagaagctggatggagacaagaaggggcgccccagcaccgccggctccaagatcaagaaacaagccaacgacctggtggccacactgatgaggtgcacaccccactacatccgctgcatcaaacccaacgagaccaagaggccccgagactgggaggagaacagagtcaagcaccaggtggaatacctgggcctgaaggagaacatcagggtgcgcagagccggcttcgcctaccgccgccagttcgccaaattcctgcagaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcgcttttcctcctggaggaggtgcgagagcgaaagttcgatggctttgcccgaaccatccagaaggcctggcggcgccacgtggctgtccggaagtacgaggagatgcgggaggaagcttccaacatcctgctgaacaagaaggagcggaggcgcaacagcatcaatcggaacttcgtcggggactacctggggctggaggagcggcccgagctgcgtcagttcctgggcaagagggagcgggtggacttcgccgattcggtcaccaagtacgaccgccgcttcaagcccatcaagcgggacttgatcctgacgcccaagtgtgtgtatgtgattgggcgagagaaagtgaagaagggacctgagaagggccaggtgtgtgaagtcttgaagaagaaagtggacatccaggctctgcggggagtctccctcagcacgcgacaggacgacttcttcatcctccaagaggatgccgccgacagcttcctggagagcgtcttcaagaccgagtttgtcagccttctgtgcaagcgcttcgaggaggcgacgcggaggcccctgcccctcaccttcagcgacacactacagtttcgggtgaagaaggagggctggggcggtggcggcacccgcagcgtcaccttctcccgcggcttcggcgacttggcagtgctcaaggttggcggtcggaccctcacggtcagcgtgggcgatgggctgcccaagagctccaagcctacgcggaagggaatggccaagggaaaacctcggaggtcgtcccaagcccctacccgggcggcccctgcgccccccagaggcatggatcgcaatggggtgcccccctctgccagagggggccccctgcccctggagatcatgtctggagggggcacccacaggcctccccggggccctccgtccacatccctgggagccagcagacgaccccgggcacgtccgccctcagagcacaacacagaattcctcaacgtgcctgaccagggcatggccggcatgcagaggaagcgcagcgtggggcaacggccagtgcctggtgtgggccgacccaagccccagcctcggacacatggtcccaggtgccgggccctataccagtacgtgggccaagatgtggacgagctgagcttcaacgtgaacgaggtcattgagatcctcatggaagatccctcgggctggtggaagggccggcttcacggccaggagggccttttcccaggaaactacgtggagaagatctgagctgggccctgggatactgccttctctttcgcccgcctatctgcctgccggcctggtggggagccaggccctgccaatgagagcctcgtttacctgggctgcaatagcctaaaagtccagtcctttggcctccagtcctgcccaggccctgggtcaccaggtcactgctgcagcccccgcccctgggccctggtcttcctccaacatcacacctgctgcccattctccatttctgtgtgtgtcaaaggggactaacagcagaatctacctcccaactgccatgtgattaagaaatgggtcttgagtcctgtgctgttggcaaagtgccaggcacagttggggaggggggggtccttaacaagcgtgactttgctcattctgtcatcactaaggcaataaacctttgccaggtgaaagcacgagttaacttactaagtgcccaacaaggacgatgttttcacagccctgtgaggtaggagctgtgaaggaccccatcttacaggtggaacaatggaggttcagagaggttcactgacccaagactgcacagagccatgccttgcattcatatgtgaccataaagcttgaatttgtcccagtttgggctgggcgcagtggctcacgcctgtaatcccagcactttgggaggctgaggcgggcagatcacgtgagaccaggagttcaagaccagcctggataacacagcaaaaccctgtttctactaaaaattt

SEQ ID NO: 156759 - DNA, 3267 bp, Homo sapiens
  Payload ID: 10729
  Gene Symbol: MYO1G
  Gene Name: myosin IG
  Uniprot ID: B0I1T2
  ENST ID: ENST00000258787
  CDS Start-End: 138-3194
actttacaccagcactggaggaggctggtggggcagggcgggggcggtggggcctcccctagccttccctccccctctccttcactgtccttccagcaggcacaggaaggtgaggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaaccccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacatgcaccaccgccatcacctacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtggcgggcccggcagctggtgaagaacatccccccttcagacatgccccagatcaaggccaaggtggccgccatgggggccctgcaagggcttcgtcaggactggggctgccgacgggcctgggcccgagactacctgtcctctgccactgacaatcccacagcatcaagcctgtttgctcagcgactaaagacacttcaggacaaagatggcttcggggctgtgctcttttcaagccatgtccgcaaggtgaaccgcttccacaagatccggaaccgggccctcctgctcacagaccagcacctctacaagctggaccctgaccggcagtaccgggtgatgcgggccgtgccccttgaggcggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtc

SEQ ID NO: 156760 - DNA, 3033 bp, Homo sapiens
  Payload ID: 10729
  Gene Symbol: MYO1G
  Gene Name: myosin IG
  ENST ID: ENST00000495831
  CDS Start-End: 109-237
ggggcagggcgggggcggtggggcctcccctagccttccctccccctctccttcactgtccttccagcaggcacaggaaggtgaggcaaggtgtttccagccggcaggatggaggacgaggaaggccctgagtatggcaaacctgactttgtgcttttggaccaagtgaccatggaggacttcatgaggaacctgcagctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaaccccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacatgcaccaccgccatcacctacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtggcgggcccggcagctggtgaagaacatccccccttcagacatgccccagatcaaggccaaggtggccgccatgggggccctgcaagggcttcgtcaggactggggctgccgacgggcctgggcccgagactacctgtcctctgccactgacaatcccacagcatcaagcctgtttgctcagcgactaaagacacttcaggacaaagatggcttcggggctgtgctcttttcaagccatgtccgcaaggtgaaccgcttccacaagatccggaaccgggccctcctgctcacagaccagcacctctacaagctggaccctgaccggcagtaccgggtgatgcgggccgtgccccttgaggcggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtcagcc

SEQ ID NO: 156761 - DNA, 2599 bp, Homo sapiens
  Payload ID: 10729
  Gene Symbol: MYO1G
  Gene Name: myosin IG
  ENST ID: ENST00000464434
  CDS Start-End: 128-760
agcactggaggaggctggtggggcagggcgggggcggtggggcctcccctagccttccctccccctctccttcactgtccttccagcaggcacaggaaggtgaggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaaggtgggcagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaaccccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacatgcaccaccgccatcacctacactacaccagccgccagctctgccccacagacaagaccatggagtttggccgagacttccggatcaagcactatgcaggggacgtcacgtaagggccccctcccacccacatccctggctttcccacaggcaccatggcatgtgtcatggggcaggagcgcttcaggggagtggctcggagacaggtgttatggccacttctgccacccccacccctttaagacactgaaacatgccggacagcagattcacaagtgaagagcaggaaacagggtttgaggatagtggttaaccatggctgcattcttctgggagcctttaaaaaatacccacgtctcatgtctgggcccaaccctataccagcatctgtggggtggggggcttcaggctggtgatgtgggggtggggagggagtggaaggtgcaggggggccaagattctgcatttctaacaagctcccaggtgaggcctcgctaccatacttggaccacgctcccagtgccaaagcccaggtgtcttcaggggttgtcatgatggctattaacttatgtgttgcttgccgcatcccaaaacgatttaaggtgactcacatcaaggtataagtgtttcatgagaacttctcaaggagagggaatagaatagatgatgacaacaaagcagcccaatatcatctacctttatctgttcgcaaaatctacacccatgaggtcgctcatgcctgtaaccccagcactttgggaggccaaagtgggtggatcacctgaggccaagagttcgagaccagcctggccaacatggcaaaacctcatctgtactaaaaatataaaaattatccgggcacgatgacgcgtgcctgtaatgccagttgctcgggaggctgaggcacaagaactgcttgaacctgggaggtagaggttgtggcgaactgagatcgcaccactgcactccagcctgggcaagagagtgagactatttctc

SEQ ID NO: 156762 - DNA, 4364 bp, Homo sapiens
  Payload ID: 10730
  Gene Symbol: MYO1H
  Gene Name: myosin IH
  ENST ID: ENST00000310903
  CDS Start-End: 59-3175
aacttttgaatggctcaagaggaatagttgttaacaacctgctctccctctgtgcgtgatggaatccaagaaagaagacgtgaggaggaaacacatccgtctgcacatggaaggggcgctgactgcccgggacaaggtcggggttcaggattttgtgctattggacgcgtacaccagcgaatctgcctttgtcgacaacctccgcaagcgtttcagcgagaacctcatatacacatatattggcaccctccttgtgtctgtgaatccataccaggagctcggaatctacactgtgagccagatggaactttatcaaggggtcaatttctttgaactgccaccacatgtctacgctatagccgacaacgcttaccgaatgatgtgtgctgaactaaataaccatttcatcctcatttctggagagagtggggcagggaaaacagaggcctccaagaaaattctcgagtattttgcagtgacctgcccaatgacccagtcactacaaatagcccgtgacagactgctgttctccaacccagtgctggaggcttttggaaatgccagaacgctccggaatgacaactccagcagatttgggaaatacatggatatacaatttgattttcagggcattcccgtaggtgggcatatcatcagttacttgatagagaagtcccgagttgtctaccaaaacgaaggcgagcggaatttccacatcttctaccagctgctggcaggtggcgaagaggagcgcctgtcttacctgggactcgagcgagacccccagctgtataaatacctctcacagggtcattgtgccaaagagtcatccattagtgacaagaatgactggaaaactgtttccaacgccttttctgtcattgattttactgaagctgacctcgagaatctctttggaattattgccagtgtcttacacctggggaacattggttttgaagaagacgaccaaggctgtgccactatcccagacacccatgagatcaagtggatagccaagctcctgggggtccacccatcagtccttctggaagctctcacccacagaaaaattgaagccaaaactgaggaggtgatctgcccgttgacactagaactctctgtctacgctagagatgcaatggcaaaggctgtttatggacgaacgtttacttggctggtcaacaaaatcaattcctccttagttaacaaggatttcaccaggaaaactgtaattggattactggacatctatgggtttgaagtctttgacaagaatggttttgaacagttctgtataaattactgcaatgagaaactccagcaactgttaattgagaggactctaaaagcagaacaggcagaatatgaaatggaaggcatagagtgggagccaattaaatatttcaacaacaagatcatctgtgatttggtagaagagagacataaaggaatcatatctattctggatgaagaatgcattcggcctggtcctgctacagacttgagtttcctggagaaattggaagagaaagtgggcaaacatgcacacttcgaaacccgtaagctggctggtccaaagggccgaaagaggattggctggatggagttccgactcctccactatgcaggagaggtcacatactgcaccaagggattcttggaaaaaaacaatgatcttctttacagacatctgaaagaagtgctgtgcaagtccaagaacattatcctgagggaatgcttcctgctggccgagttagaaaaccggaggaggcccccaacagtggggactcagtttaaaaacagtctgagcagccttctagaaaccctcatctctaaggagccctcctacatccgttgcatcaagcccaacgacaggaaagaacccagcaaatttgatgacttcctcataaggcatcagatcaaatacctggggctgatggagcacctgcgggtgagacgggctggttttgcataccgaaggaaatacgagcatttcttgcaaaggtacaagtccttatgcccagacacctggccgcactggcacgggcctccagcagagggcgtggaacggctgatcaagtacatcggctacaaacccgaggaatacaagttaggcaaaaccaaaatattcattcgtttccccagaactctgtttgctaccgaagatgcctttgaatttagtaaacatcaactagttgcaagaatccaagccacttacaaacgctgcctaggaaggagagaatacgtgaaaaaaagacaagcagccatcaaactggaagcccactggcgtggggccctggctcggaaggcaatccaaaggagaaagtgggccgtgcggattatcagaaagttcattaaaggattcatcagtcgcaacaaacccctctgtcctgacaacgaggaatttatcgtgtttgtgcggaagaattacatcttgaatctccggtatcaccttccaaagactgtcctggacaagagctggctgaggcctcctggcatcttggaaaatgcatcagatctgctcaggaaaatgtgcgtgaggaacctggtgcagaagtactgccgcgggatcacagctgagcggaaagcaatgatgcagcaaaaggtagttacaagtgaaatcttcaggggaaggaaagacggctacacagaaagtttaaatcaaccctttgtcaacagtcggatagatgaaggagacattaatccgaaagtgcttcagctaattagccatgagaaaatccagtatggtgtcccggtcattaaatatgacagaaaaggcttcaaagcacggcagcggcaactcattcttactcagaaagcagcttacgtggtggaacttgccaaaatcaagcagaaaatagagtactcagctctcaaaggtgtctccactagcaatctgagtgatggaatcttagtcattcatgtttcaccagaggacagcaagcaaaagggggatgccgttttgcagtgtggacacgtgtttgaagcagttactaaactcgtcatgctggttaagaaggagaacattgtcaatgttgttcaaggaagtttacagttttttattagtccgggaaaagaaggcacaatagttttcgacactggactggaagaacaagtctataaaaataaaaatggacaattaacagtggtgtcagtccggaggaagtcctgatagaggatgacgtctgacctctaccatcgccatttttgctccaactgaggaaactacaggggaagtggggattggatccagttagctacctcttcaaggtaccaggcccgcagcactaacagatcacatctgaagaaactgaggggcgttaggccaaagcctaatcccagctcctcagctgccccatggcaccttatttaaaatgtcaccttctggaagcagaccccaggtcacccgaaggcgcaattctaaacaccctcgacaggatctatgttcagtgcgcagtccaacgtgtcattagagggtgggcaagattctctacctctgtcaagctgccctgagacatgatgaaatactgtgtacagcaagttctcaaataacatttcgttatatgttgataagacatctgattcctgggcagggccactgtctgggtggagtctgtatgttctccccatgtctctgggtttcttctgggtgctctggtttcctcccacgtccccaaggtgtgtgtgtcaggtgcactggcgtgtctatgcggtcccagtctgagtgagtgtgggtgcgtgagccccgtgagaggaggacatcctgtccagggtgggtcccgccttctgccctgagctgctgggattgggctctggccatctgcaaccctgaacgtgcaggttggagaacgaatgaatacaaattttattgtaaaataaaaatgtatataaagcatatgagcacacaaatggacaataaatgccacagcgcaaaagcgtgtagcgagcctgccacgcttgtgactggggaggggctccgtataatctcacctttgcaagcgtttatttactgatgtatgcggccaccactgtgaccaccatcacttaccgattcaccaaaacttaggtaatatggtcttatttttgatttaattaaatatacgtgtagctcatgtatttcacagtttaatatgagaagtgctttggtctttatttagaaattgggtgatgtttttgtgcccagcaacatgctgtaggaatttaactcttgtttacatccattagcctcatggttttgcttcaagtctcagcttccaagaacctatcgatgacttactgtgcatggtctgagactaagtaaaggaaatttcctaaagctgtgaaatttgaattttgctttaaataaatggaactcacatgtg

SEQ ID NO: 156763 - DNA, 4258 bp, Homo sapiens
  Payload ID: 10730
  Gene Symbol: MYO1H
  Gene Name: myosin IH
  Uniprot ID: Q8N1T3
  ENST ID: ENST00000431443
  CDS Start-End: 1-3069
atggaaggggcgctgactgcccgggacaaggtcggggttcaggattttgtgctattggacgcgtacaccagcgaatctgcctttgtcgacaacctccgcaagcgtttcagcgagaacctcatatacacatatattggcaccctccttgtgtctgtgaatccataccaggagctcggaatctacactgtgagccagatggaactttatcaaggggtcaatttctttgaactgccaccacatgtctacgctatagccgacaacgcttaccgaatgatgtgtgctgaactaaataaccatttcatcctcatttctggagagagtggggcagggaaaacagaggcctccaagaaaattctcgagtattttgcagtgacctgcccaatgacccagtcactacaaatagcccgtgacagactgctgttctccaacccagtgctggaggcttttggaaatgccagaacgctccggaatgacaactccagcagatttgggaaatacatggatatacaatttgattttcagggcattcccgtaggtgggcatatcatcagttacttgatagagaagtcccgagttgtctaccaaaacgaaggcgagcggaatttccacatcttctaccagctgctggcaggtggcgaagaggagcgcctgtcttacctgggactcgagcgagacccccagctgtataaatacctctcacagggtcattgtgccaaagagtcatccattagtgacaagaatgactggaaaactgtttccaacgccttttctgtcattgattttactgaagctgacctcgagaatctctttggaattattgccagtgtcttacacctggggaacattggttttgaagaagacgaccaaggctgtgccactatcccagacacccatgagatcaagtggatagccaagctcctgggggtccacccatcagtccttctggaagctctcacccacagaaaaattgaagccaaaactgaggaggtgatctgcccgttgacactagaactctctgtctacgctagagatgcaatggcaaaggctgtttatggacgaacgtttacttggctggtcaacaaaatcaattcctccttagttaacaaggatttcaccaggaaaactgtaattggattactggacatctatgggtttgaagtctttgacaagaatggttttgaacagttctgtataaattactgcaatgagaaactccagcaactgttaattgagaggactctaaaagcagaacaggcagaatatgaaatggaaggcatagagtgggagccaattaaatatttcaacaacaagatcatctgtgatttggtagaagagagacataaaggaatcatatctattctggatgaagaatgcattcggcctggtcctgctacagacttgagtttcctggagaaattggaagagaaagtgggcaaacatgcacacttcgaaacccgtaagctggctggtccaaagggccgaaagaggattggctggatggagttccgactcctccactatgcaggagaggtcacatactgcaccaagggattcttggaaaaaaacaatgatcttctttacagacatctgaaagaagtgctgtgcaagtccaagaacattatcctgagggaatgcttcctgctggccgagttagaaaaccggaggaggcccccaacagtggggactcagtttaaaaacagtctgagcagccttctagaaaccctcatctctaaggagccctcctacatccgttgcatcaagcccaacgacaggaaagaacccagcaaatttgatgacttcctcataaggcatcagatcaaatacctggggctgatggagcacctgcgggtgagacgggctggttttgcataccgaaggaaatacgagcatttcttgcaaaggtacaagtccttatgcccagacacctggccgcactggcacgggcctccagcagagggcgtggaacggctgatcaagtacatcggctacaaacccgaggaatacaagttaggcaaaaccaaaatattcattcgtttccccagaactctgtttgctaccgaagatgcctttgaatttagtaaacatcaactagttgcaagaatccaagccacttacaaacgctgcctaggaaggagagaatacgtgaaaaaaagacaagcagccatcaaactggaagcccactggcgtggggccctggctcggaaggcaatccaaaggagaaagtgggccgtgcggattatcagaaagttcattaaaggattcatcagtcgcaacaaacccctctgtcctgacaacgaggaatttatcgtgtttgtgcggaagaattacatcttgaatctccggtatcaccttccaaagactgtcctggacaagagctggctgaggcctcctggcatcttggaaaatgcatcagatctgctcaggaaaatgtgcgtgaggaacctggtgcagaagtactgccgcgggatcacagctgagcggaaagcaatgatgcagcaaaaggtagttacaagtgaaatcttcaggggaaggaaagacggctacacagaaagtttaaatcaaccctttgtcaacagtcggatagatgaaggagacattaatccgaaagtgcttcagctaattagccatgagaaaatccagtatggtgtcccggtcattaaatatgacagaaaaggcttcaaagcacggcagcggcaactcattcttactcagaaagcagcttacgtggtggaacttgccaaaatcaagcagaaaatagagtactcagctctcaaaggtgtctccactagcaatctgagtgatggaatcttagtcattcatgtttcaccagaggacagcaagcaaaagggggatgccgttttgcagtgtggacacgtgtttgaagcagttactaaactcgtcatgctggttaagaaggagaacattgtcaatgttgttcaaggaagtttacagttttttattagtccgggaaaagaaggcacaatagttttcgacactggactggaagaacaagtctataaaaataaaaatggacaattaacagtggtgtcagtccggaggaagtcctgatagaggatgacgtctgacctctaccatcgccatttttgctccaactgaggaaactacaggggaagtggggattggatccagttagctacctcttcaaggtaccaggcccgcagcactaacagatcacatctgaagaaactgaggggcgttaggccaaagcctaatcccagctcctcagctgccccatggcaccttatttaaaatgtcaccttctggaagcagaccccaggtcacccgaaggcgcaattctaaacaccctcgacaggatctatgttcagtgcgcagtccaacgtgtcattagagggtgggcaagattctctacctctgtcaagctgccctgagacatgatgaaatactgtgtacagcaagttctcaaataacatttcgttatatgttgataagacatctgattcctgggcagggccactgtctgggtggagtctgtatgttctccccatgtctctgggtttcttctgggtgctctggtttcctcccacgtccccaaggtgtgtgtgtcaggtgcactggcgtgtctatgcggtcccagtctgagtgagtgtgggtgcgtgagccccgtgagaggaggacatcctgtccagggtgggtcccgccttctgccctgagctgctgggattgggctctggccatctgcaaccctgaacgtgcaggttggagaacgaatgaatacaaattttattgtaaaataaaaatgtatataaagcatatgagcacacaaatggacaataaatgccacagcgcaaaagcgtgtagcgagcctgccacgcttgtgactggggaggggctccgtataatctcacctttgcaagcgtttatttactgatgtatgcggccaccactgtgaccaccatcacttaccgattcaccaaaacttaggtaatatggtcttatttttgatttaattaaatatacgtgtagctcatgtatttcacagtttaatatgagaagtgctttggtctttatttagaaattgggtgatgtttttgtgcccagcaacatgctgtaggaatttaactcttgtttacatccattagcctcatggttttgcttcaagtctcagcttccaagaacctatcgatgacttactgtgcatggtctgagactaagtaaaggaaatttcctaaagctgtgaaatttgaattttgctttaaataaatggaactcacatgtg

SEQ ID NO: 156764 - DNA, 535 bp, Homo sapiens
  Payload ID: 10730
  Gene Symbol: MYO1H
  Gene Name: myosin IH
  ENST ID: ENST00000543960
  CDS Start-End: 1-381
cagcggcaactcattcttactcagaaagcagcttacgtggtggaacttgccaaaatcaagcagaaaatagagtactcagctctcaaaggtgtctccactagcaatctgagtgatggaatcttagtcattcatgtttcaccagaggacagcaagcaaaagggggatgccgttttgcagtgtggacacgtgtttgaagcagttactaaactcgtcatgctggttaagaaggagaacattgtcaatgttgttcaaggaagtttacagttttttattagtccgggaaaagaaggcacaatagttttcgacactggactggaagaacaagtctataaaaataaaaatggacaattaacagtggtgtcagtccggaggaagtcctgatagaggatgacgtctgacctctaccatcgccatttttgctccaactgaggaaactacaggggaagtggggattggatccagttagctacctcttcaagctacagaatcatgcagaactgtggccccaaaagctgcagggacaatagtaacctgg

SEQ ID NO: 156765 - DNA, 5581 bp, Homo sapiens
  Payload ID: 10731
  Gene Symbol: MYO3A
  Gene Name: myosin IIIA
  Uniprot ID: Q8NEV4
  ENST ID: ENST00000265944
  CDS Start-End: 167-5017
agggagcgcccgtagccagcgcccccgtaaagaaataaggaggcgcccggcttcccgcccaggcccagggccccagtgcagcctggacacagtattcaaagttttggcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggaatccacccccaaaactaaggcagcctgagctatggtcagcagaattcaatgacttcataagcaagtgcttgactaaagattatgaaaagcgtccaacagtgtcagaacttttacagcataaattcattactcaaattgagggcaaagatgtgatgctacaaaaacaactaacggaattcattggcatccatcaatgcatgggaggcacagaaaaggccagacgtgaacgtattcacacgaagaaagggaacttcaaccgacctctaatatccaatctgaaggatgtagatgatttagcaaccctagaaattttggatgagaatacagtctcagagcaacttgagaagtgttattccagagatcagatctacgtctatgtgggagacatactcattgctcttaacccttttcagagtctgggtctttactccacaaagcattccaaactatatattggatcaaagagaactgccagtcctcctcacatttttgcaatggctgacttaggatatcaatctatgataacatataattcagatcagtgcattgttatttctggagaaagtggtgctggaaagactgaaaatgctcatcttttagttcagcagctgacagtgcttggaaaggctaataacagaaccttgcaagagaagattttacaagtgaacaatttggtagaagcctttggcaatgcctgcactattataaatgacaattctagcagatttggaaaatacttagaaatgaaattcacctcttctggagcggtagtgggagcacagatttctgaatatctcctggaaaaatcccgagttatccaccaagctattggagaaaaaaattttcatattttttactacatttatgctggtttggctgaaaagaagaaactagcccattacaaactgcctgaaaataagcctcccaggtacctacaaaatgaccacctcagaacagtacaagacatcatgaataatagtttctataaatcccagtatgaattaattgagcaatgtttcaaagtcataggttttacaatggagcaacttggtagtatatacagcatactcgctgcaatcttgaatgttggcaacattgaattttcttctgtggcaactgaacaccagattgacaagagccacatttctaatcatacagccctggagaactgtgcttctttgctttgcattcgggcagatgagctacaagaagctctcacctcccactgtgtggtcactagaggagaaacaattatacgacccaatactgtagaaaaagctaccgatgtcagggatgccatggctaaaactttatatggacgtctctttagttggatagtcaattgcattaacagtttgttgaagcatgactcatcaccaagtgggaatggtgatgagctgagcattggcattcttgatatatttggctttgaaaatttcaaaaaaaattccttcgagcagctgtgcattaacattgcaaatgaacaaattcagtattattataatcaacatgtgtttgcatgggaacagaatgaatacctaaatgaagatgtggatgctagagttattgaatatgaggataactggcccctcttagatatgtttctgcaaaagccaatgggtttactttccctacttgatgaagaaagtagatttcccaaggccactgaccagactcttgtagaaaaatttgaaggtaacctgaaatcacaatacttctggagacccaaaagaatggaacttagttttggaattcaccattatgcaggaaaggtcctctataatgcaagtggattcttagccaaaaacagagacactcttcctactgacattgtgctacttttgaggtcatccgacaacagtgtaattaggcaactagtcaaccaccctctgaccaaaacaggtaatctgccacattctaaaactaaaaatgttataaactatcaaatgaggacttcagaaaaattaatcaacctggcaaagggcgacactggagaagccacacgtcatgccagagagacaaccaacatgaaaacacaaacggttgcatcatattttagatattccctgatggatttgttgtctaaaatggtggtgggccaacctcattttgtccgttgcatcaaaccaaatagtgagcgtcaggcaagaaaatatgacaaagagaaagttctgctacagcttcggtacacaggaattctggaaacagcaagaattcgaagactaggattctcccatcggatactttttgctaactttataaagcggtactaccttctctgctacaagtcgagcgaggagccccgcatgagccctgacacctgtgccaccattttggaaaaagctggtctcgataactgggctcttggaaaaacaaaagtgttccttaagtattatcacgtggagcagttaaatctaatgcgaaaggaagctattgacaagcttattttgattcaagcttgtgtcagagcattcttgtgttcaagaagataccaaaaaatacaggagaaaaggaaagaaagcgctataataatacagtcagctgcaagaggacaccttgtcaggaaacaaagaaaagaaattgttgacatgaaaaacacagcagtaacaaccattcaaacttctgatcaggaattcgactacaagaaaaactttgaaaatacaagggaatctttcgtgaagaaacaagcagaaaatgcaatctctgctaatgaaagattcatttcagctccaaataataaaggaagtgtatctgtagtgaagacttccactttcaaacctgaagaggaaaccaccaatgctgtggagagtaacaacagagtgtatcagactccaaaaaaaatgaataatgtgtatgaggaagaggttaagcaagaattctaccttgtagggccagaagtaagccccaaacagaagtctgtcaaagacctggaagagaacagcaatctaaggaaagtggagaaagaggaagctatgatccagagttactatcagaggtacacagaggagaggaattgtgaagagtcaaaagcagcatatctagaaaggaaggccatatcagaaaggccaagctacccagtgccttggttagctgaaaatgagacttcctttaaaaaaactttggaacctacacttagccaaaggtcaatttatcaaaatgcaaacagcatggaaaaagaaaagaagacatctgtagttacccagcgtgcaccgatatgcagccaggaggaaggcagaggccgtctgaggcatgagacagtcaaagagaggcaagttgaaccagtgacacaggcccaggaggaagaagataaagcagcggtattcattcagagcaaataccggggttacaagagaaggcagcagttgaggaaggacaagatgtcttcttttaagcatcagaggattgtcacaacaccaacagaagtagcaagaaacactcataatttgtattcctatcccacaaaacatgaggaaatcaataacatcaagaagaaggataacaaagactcgaaagcaacttcagaaagagaagcatgtggtttggcaattttttcaaaacagatatcaaagttatctgaagaatatttcattctgcagaaaaaattgaatgaaatgattttgtcacagcaactgaagtcactttatctgggtgtctcgcaccataagccaattaatagacgagtttcttctcagcagtgcctctcaggtgtctgtaaaggagaggagccaaaaatattgagacccccaagacgaccccggaaacccaaaacattaaataaccctgaagactccacatactattatctacttcataagtcaatccaagaagaaaaacgaagaccaaggaaagacagtcagggaaaattattagatttggaagatttctattataaggaatttttgcccagtcgttctggaccaaaggaacatagccctagtttaagagaacgaagaccacagcaagaactccagaatcaatgtattaaggctaatgaaaggtgctgggcggcggagagccccgagaaggaggaggagagagagccagcagccaacccctacgacttcaggaggctcctgcgcaaaacctcccagcgccggcgcctcgtccagcagtcctaaccgttcaacgaggcagtcaccgccgtcggaaggcgctggagcctgcggggcagcaggggccaagcaggcactctggggctggcaccagcaggcactgaagctgcggccctgatctccgcagaggctgcctgctgcgctcggccctcaagtgcccgggccggccttcgtgctccgaaacaagagacctgggagccctcgggaaacctcccccgacgctctctctcggaactcccgcaccctcctttctcaccagcccgccagttgtggcaaccctgtccttgttcccctaatctatcactttgttctttttttttgtgactcctgtggactccactgcgcctgggatctcgccaacccctctctcatttggggtgactgaattcacagatttttttttttattggaaacggcttttcttggccaacagaacacttgctagcggttgaatcttagagaaaaaagcccgggaggggtggggagaatttcgaagatgtatttcatctcaagcttgctctttctcttcctttggttattaaggtcactaaataaaggaagtgccttgga

SEQ ID NO: 156766 - DNA, 727 bp, Homo sapiens
  Payload ID: 10731
  Gene Symbol: MYO3A
  Gene Name: myosin IIIA
  ENST ID: ENST00000376301
  CDS Start-End: 12-605
aaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtcagatagagttttgaggcagacaaacgtaatagctgatcctgtttgactttcctttttatgtgtactctatctctgtaagcattttggaatataacagaagaaactctcagttgtgttattttcatgtg

SEQ ID NO: 156767 - DNA, 2723 bp, Homo sapiens
  Payload ID: 10731
  Gene Symbol: MYO3A
  Gene Name: myosin IIIA
  Uniprot ID: Q8NEV4
  ENST ID: ENST00000376302
  CDS Start-End: 160-903
gcccgtagccagcgcccccgtaaagaaataaggaggcgcccggcttcccgcccaggcccagggccccagtgcagcctggacacagtattcaaagttttggcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggtcagatgactaacattgggtccagtatctgcagcccgatttacttcctccagccaccaagtgttcatcatgctcttcatggagacgttcagatatattccaacaagttgggagcagaagatcctggaatattattctgcttcttctgagacattgtatttgttcagtagttgcatttccctggtctaagtaaaagagctttctcttgataatcagtgtgtctttctctcttttgctaggatttgatttcagaaaatagcagttcctcccaccctttatccattccccaatgagtcagtgaggcatcagagtccatagcctgtgcaagtgttttgctttgctttacctaccaatctagtaattttttactacttgctaagatttccctttgttcagaactttaaaataatattattaagaaaattatatataaaatttatccagaaaataatggttttaaacatgttagtattttgaatatgttaatataaaacaataaatttagaagaataacctcttttggtgccatgaaagcacttgactatttatgtggccccccactccttcatgtgtgtttcaacagattttcccctactatcctataaactaatttctttaaacactattttctatgagtggtggttagtcccttgatgtttcagataactaatgtgaaaagactgcctatatttattaaaggtgttatttttaaatatctttttaaggattttgccttaattataatgcagtgcacagccagagcctgtggtgacagggttccaaaacattagaatatttggcatctaactaaattattataagactaaaacatttgaattcatttttaattttgcctttgaatttcttgtcctatctagatgttccaaattataataccttggctatatatcatcctttacatactgcttattttgttaagtggagaaacaacattatggaaaagaatggaaaacctctatactaaatccaagacatttcattaattttgaagaaagcaggaaaaaaatctgtagtttctaattcctattgtcattcagtatgtaaggtgaagttctgtactgccttagctgttttaactgtggattaaaccatcatatttagtctgatgttattactcttgatgataatgccacatgaaggaaggatgacactgttgatagatattgtacctaggtaacaggcaatgtgcaaagtaattctagaaactgcatcatcttagttatttcttaattatgtctaccagcagtggaattccaagaatactgactatggtaatatggagaaaaagggaatctgaaaagctacccagttctgagtgttctgaaataatccaaactttgttattcaaagcaagccaataaatctcataaaaggaaattttcaggaggacaagaaacaaaacaacatttctggagaaaagaattacttcttttaatgtgcaaattagcaatcttcaaattgtcctaaggattgtgaaatgagcttagtcctgatctggggtagatgagtagctgcacttttctttaatgagcctgtacaaactgtacattaatttcattataagctatttaaggagtaatgcagaactgaagacaaagtatttccatttcactaatgaaaacaaagagctgttagaattaacataaagcagcacttcagcaaattcaactatcatggttgatcaatgttgcttgattacagagttagatcagcctcattttcaaatgatgttcctttgtattcaacgaatgtgccaaaaaatatatttgttcagcttaaactgaaaggaattaataaaattgttaaagttgt

SEQ ID NO: 156768 - DNA, 2203 bp, Homo sapiens
  Payload ID: 10731
  Gene Symbol: MYO3A
  Gene Name: myosin IIIA
  ENST ID: ENST00000543632
  CDS Start-End: 61-2055
gcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggaatccacccccaaaactaaggcagcctgagctatggtcagcagaattcaatgacttcataagcaagtgcttgactaaagattatgaaaagcgtccaacagtgtcagaacttttacagcataaattcattactcaaattgagggcaaagatgtgatgctacaaaaacaactaacggaattcattggcatccatcaatgcatgggaggcacagaaaaggccagacgtgaacgtattcacacgaagaaagggaacttcaaccgacctctaatatccaatctgaaggatgtagatgatttagcaaccctagaaattttggatgagaatacagtctcagagcaacttgagaagtgttattccagagatcagatctacgtctatgtgggagacatactcattgctcttaacccttttcagagtctgggtctttactccacaaagcattccaaactatatattggatcaaagagaactgccagtcctcctcacatttttgcaatggctgacttaggatatcaatctatgataacatataattcagatcagtgcattgttatttctggagaaagtggtgctggaaagactgaaaatgctcatcttttagttcagcagctgacagtgcttggaaaggctaataacagaaccttgcaagagaagattttacaagtgaacaatttggtagaagcctttggcaatgcctgcactattataaatgacaattctagcagatttggaaaatacttagaaatgaaattcacctcttctggagcggtagtgggagcacagatttctgaatatctcctggaaaaatcccgagttatccaccaagctattggagaaaaaaattttcatattttttactacatttatgctggtttggctgaaaagaagaaactagcccattacaaactgcctgaaaataagcctcccaggtacctacaaaatgaccacctcagaacagtacaagacatcatgaataatagtttctataaatcccagtatgaattaattgagcaatgtttcaaagtcataggttttacaatggaggtgctgggcggcggagagccccgagaaggaggaggagagagagccagcagccaacccctacgacttcaggaggctcctgcgcaaaacctcccagcgccggcgcctcgtccagcagtcctaaccgttcaacgaggcagtcaccgccgtcggaaggcgctggagcctgcggggcagcaggggccaagcaggcactctggggctggcaccagcaggcactgaagctgcggccctgatctccgcagaggctgcctgctgcgctcggccctcaagtgcccgggccggccttcgtgctccgaaacaagagacctgggagccctcgggaaacctcccccgacgctctctctcggaactcccgcaccctcctttc

SEQ ID NO: 156769 - DNA, 5479 bp, Homo sapiens
  Payload ID: 10732
  Gene Symbol: MYO3B
  Gene Name: myosin IIIB
  Uniprot ID: Q8WXR4
  ENST ID: ENST00000317935
  CDS Start-End: 144-3899
ctagatcgaaagtcctttggtaatgatgtgtcatacattctagtcatcaaagacaccattttctgggcctgaagtgttctgctggtttttggaggaatgagaatccaatctctcataagccggattcagaaaataggtcatcgatgaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccgttctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctgcctttccacattacggatgtaacttttatgggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaa

SEQ ID NO: 156770 - DNA, 5529 bp, Homo sapiens
  Payload ID: 10732
  Gene Symbol: MYO3B
  Gene Name: myosin IIIB
  Uniprot ID: Q8WXR4
  ENST ID: ENST00000408978
  CDS Start-End: 144-4169
ctagatcgaaagtcctttggtaatgatgtgtcatacattctagtcatcaaagacaccattttctgggcctgaagtgttctgctggtttttggaggaatgagaatccaatctctcataagccggattcagaaaataggtcatcgatgaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccgttctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcagcctggagaggatatgatgctcggaggaaatttaagaaaataagcaacagaaggaatgagtctgctgctcataatcaagcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaa

SEQ ID NO: 156771 - DNA, 5448 bp, Homo sapiens
  Payload ID: 10732
  Gene Symbol: MYO3B
  Gene Name: myosin IIIB
  Uniprot ID: Q8WXR4
  ENST ID: ENST00000409044
  CDS Start-End: 144-4088
ctagatcgaaagtcctttggtaatgatgtgtcatacattctagtcatcaaagacaccattttctgggcctgaagtgttctgctggtttttggaggaatgagaatccaatctctcataagccggattcagaaaataggtcatcgatgaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccgttctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaa

SEQ ID NO: 156772 - DNA, 1720 bp, Homo sapiens
  Payload ID: 10732
  Gene Symbol: MYO3B
  Gene Name: myosin IIIB
  ENST ID: ENST00000442690
  CDS Start-End: 1-1081
gaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccgttctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggtactaaatatttagtagacaattctcattgaagacatttgtttcatgtgaatggtctgaactttctgttgtagaccatgtcctcctaaggtcatttgaaaatttaattgtttgtgtagctatgggatgaagttcagggagcattcagttgctgtgactatgatcctgtgctgtgtttatttagatagcccctagaatgatgaagagaaaaggatttggatttttgcaataaagctctttatattgtagccttaatgatggattatatcagctgaaaatattttgtttgataaaatttgataaaatatttcaattaacccttaagaagttgtttgttcttcataagaaagagcttcatttagggaaatagtgaagttaatatagcttgaattctaaatttgaagtctgtgataatccccatttaaaatatgcatgtttaatagagctgttaattgcactggacctgtttatgctgagtctaactctggggattgttaccttcaatgtctaaatcactaaagtgtaatacaaagtggttaattctgtatttatgccacctaggttttaagtgcagtgctttgagaaattaacttaccattctgtcggtgctctatcagtaggaacagcctattaaataaaattttaaatacaaca

SEQ ID NO: 156773 - DNA, 3320 bp, Homo sapiens
  Payload ID: 10732
  Gene Symbol: MYO3B
  Gene Name: myosin IIIB
  ENST ID: ENST00000484338
  CDS Start-End: 5-3320
gtgcatgctgcagagtgctttactttcaacaaggaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccgttctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcag

SEQ ID NO: 156774 - DNA, 12411 bp, Homo sapiens
  Payload ID: 10733
  Gene Symbol: MYO9A
  Gene Name: myosin IXA
  Uniprot ID: B2RTY4
  ENST ID: ENST00000356056
  CDS Start-End: 474-8120
gcgcgaccgaagcggataagggacgcggcggcggttggctgtgtctgttgagagagtacaggacagcccggactgcgagaggcggcggcggaggcagtagttgcaccggcagaggcggccgctggcagcggttgaggcggcggtccaacgcgtgctctctgggcggggtgcggcgggggatgtgcctgctcaggccgggcggagtctctctgacagggcgggggatgcgccgcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcgaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaaacaaaaaaaaaaaaacaaaaaaaaaccgtgattgtttccattaagccatcagagcgtgtctcagatatcttgttatacagtgaagaagagaatacctattttttttgatgatgtttgatgtcatagtaatcagtgctggtttaactcctgtttagttcctgccaaatacattgcatgggctgaagtgtcagtagccatactgttctcatgtttcttggtcctaggatcagattcttctacattattttttagtttcccagagacatggtgatccctaaacttatgaaggtttcatcctaagccattcaggcttttctctttgtatagattaaaccgaaaaccgcatatgagcctgttcatctgctggtggattcccaccacagactcagactcaaacaaacaaacaaataatgtgaccgtttagttagtttccaaaaacattcacatacaatattgcatgaataagtaagtaagtgttacagaaagctgccaaaaaataaaaaggtttttaatatgacctatctaactaactaacttttatcttccttttctcagactatcagtattaaatagatggaaaaaaatcaaggactacttgaagctatttttgttaatattctggttactgaagtttattgtaaatatgtatgtatagtaggcatatttctttttaaccttgtgcttccctccttcccatggaatttcttcccacagatgaggggccactggacagggggatgagagccattcgtccctgggttgagggaattagtaagacatcattttcaccactgggtggtcttcatacacatgagttataatagcattttaagtatcttagcatttgtgggattagaaatctgtttttgctatttataatatataaaaaatgaaacatgatagcctttcttgagataagtatgtgaaatgtttatttttaaagttactaaatgcatcttgtcttgctactacatgcactgctctgaaaaagagcctttaccatctataacctgtattttgggtattcttccttttcatacttctttgaagttgtggaaatattaagtcttttgttaaggcagagtctctctctcctgttacacaacactgaacctcacgccactgcctcagtggttattggccagccccagaggttagacttggagcataattctgagtggcagctaaaggtagcaggagtcttacctctccctactttgggttcagaattgagccagagaaaggaagccattaaaatctccagaataatgatagttaatgagcaaatgttatgctttatatcccacagacatctgccaccttgttcatcttgtcctgaggagtaataaataatgttaagcttttaaaaatctgaatttcagagaatctcctagaggatagaggaaaacccctcagcatggtgtgttagagtgggattgctggttcctcagccccgtgccaggttgcacagtctgtgtttcagtgttcttgggagagtagtgtactgctgggcattaattgttactctgcacttgctccagaatgttggttaaatcctgtatgaaaaaaagagattgcccttatggaataatttcctgtggcccagaggaatggccagaagaacatatgttggcacatgttcttccttctaaatctttgtggggcttttttggcaaaataagttttttggcagttaaaaaacgactgatgtaggtcactttaaaggaactaggtgatggatgttaagagactttataatttttctcagggacctgaaactccagtttggataaaattcaattaaaaaaacttgttttttcagttgctagatttgtggatttctagtaatttaatctgccaggattggggtgggtgggtgaggaggagagagccacaaaatgataagagtggagagcagtgtggggccctccctttgagggaaagccgttgtttacatagggtagtaggccttgttggcctgatcaagagatgaagccataactcttaaaaaccttcagaaccaaacgctgtgtctgcatccatctgttctcactggccctctgcatggtaaagttatgtcaccacaaagtgatgccgcattacaatcacttatgaaactgttagcccttaatatgcatcacatttgtggttccatagtgcttctcctttgcttgtttgatctctgcatggcagcagtggggcagctccacatttggagcccatactccaaaatgcagagcactcttctcacagcacacattcccagccccaaacaaaacctgaattttcaactctgcccattaaagtgaatgtatccctgtaatttagtatgtacttattatggaaaatgtaacaaaagcagagaagtgtgatttcattctgtatcacaaattgaagcaaatcaacagcaaatacagcaggattcagggaggcttagtttacaacgtactttgtacctcctgccatttaaattattttgccactctgggcttctgaaaacacaaagggagatacagccctccaactatgagccttgcagagagagacaaaagggccagaggtcctgggatggaatactagagcccccaccttctcatgctttggaaacctgccagagcacttaccctgctggaagattaatgaagactccattctgtgtttcataacagtagcgttgttttctccatcaaaaacagagggtcacagaaatgtgctgaaaagatgtggtccagcaaggttctgtagtcccacctcagtgcctgtgggctgtgtttttcactgtaacaagcactttggtaaactagaaagaagaaaggattctcaggatgtgttcaaagctaagagagttttcattttaaaaagaaacatacatactcactccatggctttcctcatcctcctctcttttttcttcttggtgggaagctggatgcggggcatgcatcattctgtatggacaaatgtgttatgtccacccatactcttgtgacaactccccagcactgtcctgcaataccatgctggccttggtagtaaaactccttggtatctgtgagagtcctctttttctatgccctagactacttttaaccacttttctctggaatgactcccacatttgattgggtattgaaagggtaacagcaaaatgatgattgtggagatggatctattaggtctcatgttggtcccctggttgaaactattttcaaaaaagccccaacaatgggcctgtcaccttgctagtcatccattcttaatgcctatttatcagccctctgaggtcatataaaagttgcaccttttgaaccaagtatttgtatttactatgggaaaggtgtggactacagattcgtattatattattttaatggattttaagtaatttataagtatgctgagtgtaaattttttttaaaaactgtattataaaaggacatatcctgtgaaatataacattttactgtttaatagaataattctataagaagaatgatttatctcacccacggaactgattacattccggatgcaatcaataggcactttgtaatttcctttttgtttttttttctttgctggggggttgaggggtaacaagataccatctgtataaagtgcagtttgtgtcactcaaaatatgcactgtatggctacacaaaagcagcttgatgaacaaatcaccccatggctcattaaagaacaaagcttccagaagcagc

SEQ ID NO: 156775 - DNA, 7749 bp, Homo sapiens
  Payload ID: 10733
  Gene Symbol: MYO9A
  Gene Name: myosin IXA
  Uniprot ID: B2RTY4
  ENST ID: ENST00000444904
  CDS Start-End: 103-7749
ggggctgcggtggccaccgcggcggagccagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcgaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctga

SEQ ID NO: 156776 - DNA, 4008 bp, Homo sapiens
  Payload ID: 10733
  Gene Symbol: MYO9A
  Gene Name: myosin IXA
  Uniprot ID: B2RTY4
  ENST ID: ENST00000424560
  CDS Start-End: 443-2632
gcgcgaccgaagcggataagggacgcggcggcggttggctgtgtctgttgagagagtacaggacagcccggactgcgagaggcggcggcggaggcagtagttgcaccggcagaggcggccgctggcagcggttgaggcggcggtccaacgcgtgctctctgggcggggcggagtctctctgacagggcgggggatgcgccgcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggtaagtagtagttattagtattctaccatacttcatctttttttttttttttacctttctacttctccacaaaaaggagtagaattcttgctatgagattctcaaggacaaaaatcctgcttctgtagtcaatctagtgtcatctcttaactgatttgtgactatgaacagtttttcttttctgtaaaagagttatactgcctttaaaataatgaggataaagtcagagcatctgttcatgaagtgttcattttcttttcctttactcttagttcatggatttttaaaaactttgaaatttagaaatagataaagcaggatactttttctgtatgcctcccccttcaatcataaaatctctcatctcattttctgtgggagggcaacttcataagcacttttggcctactggaaaccaaactattgtttgctgtagctctagtcttagatagggccattgctgcatagagaagattttgtgatacatatgcagttgagatttatgcctttcagtagaaatgttatagggctcacctgtgctttcaggactcccaaagtgatttacgtggctttttgggatgtgcactagtagtaaaacttttaagtttagcttttaaatgtttgagacaaatagatatatttgagagagtgtatttctaaaaatacatgtaaaataattgaacctagtttccattttttagattgtaaagtatttgaactggtctttgtagatgtatagggagaattatagtttattagagaaataaaaggactatctcaaacctgctttgccttttacaaagtgatttctaagaggttatctttgtaaaaagctttaaggaaaattttttttctttaagatgctttcttgtttattatgacaaacttctaatcaagaaaaccactcaaaattgattagcatcctgctaagacataattgagtaagagaagaaacttttcttgtatttactgtcaaagcctatttactttattcacattatctgtatattcctttggcatttaaaatctattatttgtgaaagctagttgttacatatctgttattatcaatatcggcaatgacatgcaatgttattaatgataaacaacctgtattttctctaccttgataaagtctagattccttattttctaatcttgttttcccttctggctagtacagagcttccatataataatctctttttgaaaatttgtattcaacataacatgcatatacaaaagtacacaaagcaaaaatgtatagttcagtggagtaccacaaagtaaacacaaccctggaactaccacctaggttaagaaacacaacattccagccacccaaaatttctccttggaaaaaactttaaaatttttacttttt

SEQ ID NO: 156777 - DNA, 5111 bp, Homo sapiens
  Payload ID: 10733
  Gene Symbol: MYO9A
  Gene Name: myosin IXA
  ENST ID: ENST00000566885
  CDS Start-End: 639-4544
cggcggcggaggcagtagttgcaccggcagaggcggccgctggcagcggttgaggcggcggtccaacgcgtgctctctgggcggggtgcggcgggggatgtgcctgctcaggccgggcggagtctctctgacagggcgggggatgcgccgcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcaggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtaaggctacaaatcctgataaactgttatcacatatccatttggaaatggaaaccaggagcatcctacaccagggtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcgaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattcccctgtaagtgaaatgtttatttatgtataaatgggaaacttcttggagtatttttattaaggtgccttgttctgctccaactatttgtgtaaagtggctgctcaacttggccattttctctttgtaaaaatattccctaattgttgactctaccatcacctgaagttggatgtagttatatcctaggaatccttgactgatcatgaatagcagagtaaatactgggttcctccccattaagtgagaagcatttgtgaagggcagtacagtgcctataaacatagtaggcattcaccgaatactggttgctttacagctgtgaagtttagtagttgaaggttgtttgtttcaggctttaaagaagttaatttgttttgttacagctgttggcctatttatggtcatcattacgttcattatacttctttgtatgtgataaacacataacataaaatttcccatcttaaccatttttaaataatatagtacagtagtgttaactgtatatacattgttttgcaaaagatctctagaactttttcttcttgtaaaataaaactctgtacccattgaa

SEQ ID NO: 156778 - DNA, 560 bp, Homo sapiens
  Payload ID: 10733
  Gene Symbol: MYO9A
  Gene Name: myosin IXA
  ENST ID: ENST00000569314
  CDS Start-End: 139-560
agtggcgtcacgtgcgggggcgggacagggcggggccgacccgtgctggcagtagggggcgtgggagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttcc

SEQ ID NO: 156779 - DNA, 582 bp, Homo sapiens
  Payload ID: 10733
  Gene Symbol: MYO9A
  Gene Name: myosin IXA
  ENST ID: ENST00000568481
  CDS Start-End: 1-582
tttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcagttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatag

SEQ ID NO: 156780 - DNA, 8111 bp, Homo sapiens
  Payload ID: 10733
  Gene Symbol: MYO9A
  Gene Name: myosin IXA
  ENST ID: ENST00000564571
  CDS Start-End: 161-7351
catctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcgaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttccc

SEQ ID NO: 156781 - DNA, 564 bp, Homo sapiens
  Payload ID: 10733
  Gene Symbol: MYO9A
  Gene Name: myosin IXA
  ENST ID: ENST00000564931
  CDS Start-End: 345-564
gcgctgagaatccaggtccagaatcgggagggagcacggatacgccagaatctgagtgggtgggagagcgatccactgccgagacaaaccgaagtggggaggaggcttcttacctgcctcgggcctcaccaccccaaccagccttcaggcacctctgtgttggccggaaagcgacagctacggtcgcaaactcagaggtttcgtccccaaccttgcgacatccctttccagtacagggagaatctaaagctgagttccctgctctgccgtaagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaat

SEQ ID NO: 156782 - DNA, 549 bp, Homo sapiens
  Payload ID: 10733
  Gene Symbol: MYO9A
  Gene Name: myosin IXA
  ENST ID: ENST00000568438
  CDS Start-End: 1-271
ttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgagtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatgg

SEQ ID NO: 156783 - DNA, 1922 bp, Homo sapiens
  Payload ID: 10733
  Gene Symbol: MYO9A
  Gene Name: myosin IXA
  ENST ID: ENST00000568042
  CDS Start-End: 1-1391
ataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgaaacctgtactaattgcagttagattcatgaacattacccgcaattcagtctcgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactcc

SEQ ID NO: 156784 - DNA, 4784 bp, Homo sapiens
  Payload ID: 10733
  Gene Symbol: MYO9A
  Gene Name: myosin IXA
  ENST ID: ENST00000561618
  CDS Start-End: 1-4196
gttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagaggttgccagaccggcccataaaaagaaagctcgaatggcgcggacgcgctccgatttcttgactagaggtacttttgccgatggggagggggatacagaggaagatgattacgatgacattattgagccccttctctcccttgaccaagcttctcactgtgagctagggcctgcacccagcctgggtcaggcctctcacagtgactccgaaatgacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaaacaaaaaaaaaaaaacaaa

SEQ ID NO: 156785 - DNA, 7532 bp, Homo sapiens
  Payload ID: 10734
  Gene Symbol: MYO9B
  Gene Name: myosin IXB
  Uniprot ID: Q13459
  ENST ID: ENST00000397274
  CDS Start-End: 63-6131
ctagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacatgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgc

SEQ ID NO: 156786 - DNA, 2087 bp, Homo sapiens
  Payload ID: 10734
  Gene Symbol: MYO9B
  Gene Name: myosin IXB
  ENST ID: ENST00000597073
  CDS Start-End: 1-588
caccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaagcaagacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacatgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgag

SEQ ID NO: 156787 - DNA, 495 bp, Homo sapiens
  Payload ID: 10734
  Gene Symbol: MYO9B
  Gene Name: myosin IXB
  ENST ID: ENST00000602158
  CDS Start-End: 1-179
agcaggagcgtgctgtgagtaggctgcacatagatgagagtccgagcaggcgaacattggcaggagcatgcacgtgtgtgtcagtgtcaatgtgcgcatgggcccgtctgcacgcgtatgtgtgcgtggacacgtgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctc

SEQ ID NO: 156788 - DNA, 461 bp, Homo sapiens
  Payload ID: 10734
  Gene Symbol: MYO9B
  Gene Name: myosin IXB
  ENST ID: ENST00000594971
  CDS Start-End: 1-461
caaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccggaaaagtaaaggtatcaaacaaaagcagatcattccaaagaacctactggactccaagtccctgaaactcatca

SEQ ID NO: 156789 - DNA, 7595 bp, Homo sapiens
  Payload ID: 10734
  Gene Symbol: MYO9B
  Gene Name: myosin IXB
  ENST ID: ENST00000594824
  CDS Start-End: 148-6621
cggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaagcaagacatcacctaccggctgccggagctggacccaaggggctcggacgaggagaacctggactcggagacgtcggccagcaccgagagcctgctggaggagcgggccgggcggggggcctcggaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacatgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgag

SEQ ID NO: 156790 - DNA, 7623 bp, Homo sapiens
  Payload ID: 10734
  Gene Symbol: MYO9B
  Gene Name: myosin IXB
  Uniprot ID: Q13459
  ENST ID: ENST00000595618
  CDS Start-End: 153-6221
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacatgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgca

SEQ ID NO: 156791 - DNA, 544 bp, Homo sapiens
  Payload ID: 10734
  Gene Symbol: MYO9B
  Gene Name: myosin IXB
  ENST ID: ENST00000598419
  CDS Start-End: 1-525
accagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaagcaagacatcacctaccggctgccggagctggacccaaggggctcggacgaggagaacctggactcggagacgtcggccagcaccgagagcctgctggaggagcgggccgggcggggggcctcggaaggacatcaggcccactggtgtaaccaaggtgcagatgacctaaggtgtgggaaaacatgaaggctgcatgccaggccct

SEQ ID NO: 156792 - DNA, 524 bp, Homo sapiens
  Payload ID: 10734
  Gene Symbol: MYO9B
  Gene Name: myosin IXB
  ENST ID: ENST00000602177
  CDS Start-End: 1-524
gccggacgcctgcgggccgagagggccgaaaaggctgcaggtatgagcagccctggtgcccaaagtcacccagaagagctgccaagaggagccagcaccccttcggaaaaactttaccgctgctcaatgctagatttctcatttgacggctctgaggagttcgatattaacgcttttgaggacatcattgctttctatgaaagcaagaagaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcg

SEQ ID NO: 156793 - DNA, 6215 bp, Homo sapiens
  Payload ID: 10734
  Gene Symbol: MYO9B
  Gene Name: myosin IXB
  ENST ID: ENST00000595641
  CDS Start-End: 1-6215
atgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccg

SEQ ID NO: 156794 - DNA, 584 bp, Homo sapiens
  Payload ID: 10734
  Gene Symbol: MYO9B
  Gene Name: myosin IXB
  ENST ID: ENST00000596942
  CDS Start-End: 1-584
gaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctaacaagagccccaagacccgggacatccaggaggaggagctggaggtgctgctggaggaggaggcagccggcggcgatgaggaccgggaaaaggagattctcattgaacggatccagtccatcaaggaggagaagcaagacatcacctaccggctgccggagctggacccaaggggctcggacgaggagaacctggactcggagacgtcggccagcaccgagagcctgctgg

SEQ ID NO: 156795 - DNA, 5892 bp, Homo sapiens
  Payload ID: 10735
  Gene Symbol: MYLK
  Gene Name: myosin light chain kinase
  Uniprot ID: Q15746
  ENST ID: ENST00000346322
  CDS Start-End: 295-5832
ggtcggcagcagggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactc

SEQ ID NO: 156796 - DNA, 7531 bp, Homo sapiens
  Payload ID: 10735
  Gene Symbol: MYLK
  Gene Name: myosin light chain kinase
  Uniprot ID: Q15746
  ENST ID: ENST00000354792
  CDS Start-End: 187-5724
ggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttc

SEQ ID NO: 156797 - DNA, 7585 bp, Homo sapiens
  Payload ID: 10735
  Gene Symbol: MYLK
  Gene Name: myosin light chain kinase
  Uniprot ID: Q15746
  ENST ID: ENST00000359169
  CDS Start-End: 187-5778
ggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttc

SEQ ID NO: 156798 - DNA, 7738 bp, Homo sapiens
  Payload ID: 10735
  Gene Symbol: MYLK
  Gene Name: myosin light chain kinase
  Uniprot ID: Q15746
  ENST ID: ENST00000360304
  CDS Start-End: 187-5931
ggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttc

SEQ ID NO: 156799 - DNA, 10027 bp, Homo sapiens
  Payload ID: 10735
  Gene Symbol: MYLK
  Gene Name: myosin light chain kinase
  Uniprot ID: Q15746
  ENST ID: ENST00000360772
  CDS Start-End: 380-5971
ggctccccgcgccgcccggtcggcagcagggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaagcatttcttccttctgatggggcaagactctctctggaatggggctcttatgacctacagtcaaacaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaatctttgcagacttctctttctttccatgctaccagttgtaaaggacacagctatatcctggaaatgaaaaacaaacactgtggtgcctagatgtgaagaactggcttatgtggttgtgttttgctatggaacagaatgatttaggaagttcttgtttatataggtagccgaatttacacatttagttcaaaatttctcttgagcatcagcttagtactatatcaatcattctagaaggatatcttatagagcaggtgtccccaacccccggtaagtagcctgttaggaaccaggtcacacataaggaggttagcagtgggcaagtgagcaaagcatcatctatatttacagccgatccccattgctcgcattaccgcctgagctctgcctcctgtcagatcagcggcagcatcaggttctctcaggaacgaactctattgtgaactgctcatgtgagggatctaggtttcacgctccttatgagaatctaacacctgatgatctgtcactgtctcccatcacccctagatgggacagtctagttgcaggaaaacaagctcagggcttccactgattctacattatgatgagttgtatacttattttatattataataaaatatattattacaatgtaataataatagaaataaaatgcacaatacatgtaatgtgcttgaataatcccaaaaccaccccctctcctggtccatggaaaaactgtcttccatgaaagtggtccctggtgccaaaaaggttagggaccactgttacagagtatcaggtcctcaagatgctaaaatctatatgacatttttaacatgtgacattatcatcatcatcatcatcatcatcactgatgatactatttaccagggcatggtttgaattggtgactttggtgcagttcattattggcagccaaatgctttatccataccttcatattgaagaatttgttatcaggaaactaccagtcctgctttacaggaagtctgttatcagatatcagatggcaagttccccatgtcttcagatgttcaaacaatattgtggatggtctagaaagagtttaagacatgctgttaaatgtagggctagataattctctgattctttgatgtagtctggaaagaaacaatccattgtccagttaataaatatttagtgttttcatttttaagacactcacaatccacaaatgtccctaacaatttattatttttaaagaaaatgactttttattccttgctagtgaaaaatgtacaatttatatgctgcactgagaaaaataacagatatactttcttccattcattttcatcccaaacatataaaaaataatccattgattgttccttgcattgcatatcttattaaaagatatttcctacatgcaactaataagacatgctgactgttgtcagctctaaatttatgtaaagattttttatttttgttaaaatgtttgaaatttgctttttgctccacacctcacctgtttttgataaatctgtgctaataagtacataggaggtaataaataattgagttgtgagaaacccaattctccatttttcaagaaaacacaagtagcactactctctttatcccttgggactccttcctgtaatttgaaagggggggctaatgttggtggcagttgttgctaaggatctctgcacagagttagggcttcactctcggcttcctggttagatggggccatgtgactagtcctagtcagtgagctgtgaccagaagtgatgtatgtaccctcgggaccagagcatttatgtgctggtacaagcctctccataatgacgggcaacacatgagatggtggctgctgcagccatctgggtctctagccaacccaaaatggggacataacacaagcaagaaataaacatttgttcttataaatcaccaagattttggggttctcagtggctgcaacataacctagactatcctgatacaggcttatcaccatgttctggatgtgtggtgaccaggatggtagccactactcacaagtggctatttaaatttaagttactttaaaaaataaaataaaaaattcagttcctcagttgtatgagttacatttcaaatgctcgacagtcacatgtacatcacttttcaaattatgtgaaattaaaactgaaaagcttgtgtgaaagtctagagagtatggtctatagtttcatcaattgtattggataatatagtctcgatactcaa

SEQ ID NO: 156800 - DNA, 5901 bp, Homo sapiens
  Payload ID: 10735
  Gene Symbol: MYLK
  Gene Name: myosin light chain kinase
  ENST ID: ENST00000464489
  CDS Start-End: 289-501
cagcagggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaa

SEQ ID NO: 156801 - DNA, 5745 bp, Homo sapiens
  Payload ID: 10735
  Gene Symbol: MYLK
  Gene Name: myosin light chain kinase
  Uniprot ID: Q15746
  ENST ID: ENST00000475616
  CDS Start-End: 1-5745
atgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtga

SEQ ID NO: 156802 - DNA, 820 bp, Homo sapiens
  Payload ID: 10735
  Gene Symbol: MYLK
  Gene Name: myosin light chain kinase
  ENST ID: ENST00000508240
  CDS Start-End: 133-820
aacaaacaagtgtccgagctggcaggacgacccagcagggtcagccgtgaggaggagggagcagagcgaggtccgtgtgggagacttcctagaggagatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaag

SEQ ID NO: 156803 - DNA, 7282 bp, Homo sapiens
  Payload ID: 10735
  Gene Symbol: MYLK
  Gene Name: myosin light chain kinase
  Uniprot ID: Q15746
  ENST ID: ENST00000418370
  CDS Start-End: 5023-5487
catgaaaggatgtaacacgcaccaagatgtataaactatccggatagttctccatagccatgggtgtgtatggatagaacggacctggtcgcaaccagagttggatgtgattatgaggaaatgctcccaggtgcaggagtttgaattaggtgtggaacctcagtcagaatacagagaagaggactgcacaggtggaggagaaggcacagaggtgggagccggacccattccggctgggcttggctggacaggagcagagtcttttagctggatactcaagggacccaggggcattgagactttgcctgggtggcaaagaaaagggaaatcactgtgttggaggcaactggaacactggtcatttaccacaccaggtgactaaatcacagttgcctcagaaagtagagtgtcactcagaggttgaaagagggagcaaaggcgaatgggggccacaagtgtggagtttaagtgaccaccatcctgagcacatatcagctgtgctcctccaccatggaagtcagttcctggctacacccctcatgggaaggtgggtctccaggcctccctcaagtgcaaggtgagttgaaacatctgtagctgcttaccttttggtgccactaggatctgagtagcaaatattctttttaaaaatgtgggggaggatctacaaagtcaaagtcagctgtattaataatcctgtagccagcaggtctcaaagaaatatttctggaaaggatagggaagctgatgtcagggcggggcagtcctcagagcagtgagtctaagtggatattgcttggctgaggctataggttaaggggcagccttatcacctgggaacatctgcagatgaactaaagccaggaggatgcctaaacccaggggctaggagcagagaagagatgaggaaacaggagaggaggcaaagggaatttttcagttaaatcagtcagggaatcatagtggtgctgatttttttttttttttttaaagagacagggtctcatgctgtcacccaggctggagggcaatggtacaatcatagcttactgcagtctcaacctcgtgggctcaagcaatcttctcgactcggcctcctgagtagctgggactacaggcatatgccaccagaccggctaatatttttttttctcctttggtagaaacagggtctcactatgttgcctagactagtcttgaactcctggcctcaagcgatgctgctgcgttggctgcccgaagtgttgagtgcccagcctatgctgatattttaatcaatttttttttcttcttgtttacggcattattagccatagggttttctggaagggcgggggaagaaaagggtagaattcagagaatgaaccttaattttatattttagtatagatggcgacatttggaaatgatttttccacaaaattgcacacaaaagttgtccacaaaaattccattcaacaagtagtttccctgaagagtagcttccctggtaacagctctaaccatttcatgttacgttgctccctcaggaaaacgttttctgcattttaactgcaatcaccagggccttagctccccttggaatatgagggttccctcttgcagcagccaaggttctgtgcagtggggtggagtgggctgtgggcgggggcagagggagaggggaagatcaggctcaggtggcccagaactctctgcagctgtgccagagaaggcaccttcttgttattctggtgtggttttcataaaaagccctagaaggaatgaagtgacatgggaacaaatccctacaagcaaagctaggctgggtatagatgactaatcatattactcatcttggaatcaagttattccgaaagaaggtatattttaaatttatattaaaagaattttacaaagatatgttggaaaggtgtagcaatgggggcaggtaggttgagcagattaacagggtttccgcatgcacactggaagcaaaagactagacatcagaggcccttaggtagccatctttattttctgggaaccataaagaccccagcagtatggaccaagggcattaggggagaaaacactggactcagtatagcacggagtattcttggccatcccatttggatggtatgcactgctcaggggaaactgtagtcttggggctactggtatatatggggggctttgatgggtaaccagcttgctgtatgtatgtcagggaatgtcttagtattggtgccaaaagaccctaatcctgggaaactccacaagcctgcctgggcaagccaggatggctggccccacaagctctccaaggggcagggaatttgtgctgcatgaaggaggctggtgcagatactgctcaccagcgacacaggaacccagcctgggcaattgccctcaagcaagaaaaagggagaaattacaaaatcaaaacttggcgatcttgatgttccaaaaatttccaaaggtctttggtcagtaaagcaacaaccaattgtcagctcaaaggcataaaactggaagactagaacatactgatatattcatttctagttctgacaaataacttcctcggcaattttttttcacaaatcaattcccaaatatttttctatgttttagaaattatatgctggatatctccatcttttagaaaagttctccctatgtgagacatatttatttgttaatatatttactacttcctctgaaatactataactcttttgtttcctcattctgatagcttcattttagtcattttgttatgaaataaaatctggaagaaaaaagacatcgtctcgccacaccacacaggtgaagacagtcctcatcagtcccaatcctgatgtctggaattggggagcccatgggctcaaggcgggtgttccttgctacacatttatggatataaaccagagtcgttctgtagaggtctggaactgcaggaagattagaatcttctgctcccaggctactgaggcccagagaggggaactgacttgcacaaggtctcccagcaattagggttagagaactaacctgtcccttgttgggaatgaaccctctgggtttagaggctcctagcccaggacaaaccaatctgtgttggataaagggaatggagagcagagaagggccgagtctgagaatcgggttgattaggaagcaggctggtctgacattgactacgtagggagggctgccatggctggtaccacctcttacctgttcctgagggcagggtaacctcccatgggaagagctgggtctctctctctctacactttgtctagcacaacaaacaggttgaaccagtaacatctcccagaagagcatgaaaggttgccacgtggcctgagcctgcagaggcattctccgcagggccacacggtggttctgcgcacagttaagttgttcagttttcatctctcaccatcttcccctcctcatcacctccacctggggctgcgtggattctgttcagcgacccagcctcactgtggtggcagaggccagaaacatacccacaccatacagtgtgatgtgtgtgagaagggatggccaggggacagagcaaggtgaaatgtctgtccaaagtgcatgagagcagtctgcagcaaggatggcaggaggcatgacagtaaggtcatcccgctcactgcagtaggtctcctctttaaccatacacacacgcacacaattttctgtatgtttccttagcacccagaagttattcactttcaaaatgatcagtctttttactgaagcttactggctttccaactagtcctaaattgtgaggctttactgaagtacttgagcatgtgaagtgaactgaggaggaaaatggctttgccggcagagtttgagatgcaacgagtacaagccatttgcctatgaagaggctgtttcctccctctctcagggaggacaagtagccagtctgtggtgacatctgttgtctagatgcacagcttttcgatgcctaaaaaagatgctttgggtgcaggggtggaaagacttggttgtgccttagttttcttatcttagtcattcctgttaaccttagaaaaaaggtgaaaaacttactgaaagataagaaacaataagacacaattgtacattattagggatcctatgcttggtagaattttcgcaatgtaaataaattacatctcaagttctgatccttttcagcagaaattctttcctctcccaagtctagtcactgagaagcaaagtgccgttgccttttatttcttcaatgcttctttttggtgcctgaatgcacaccaaggaagagctcctctccagagcttcactgcatcatagacttgtgcaggggccagccagagtgtttctcaaaatcttttaagtctctgaattataaacagagctaaatgggaccttggagatcatcttgtccagccccctcctagagaaggagactgaagctcagagtggttaagtgacttgcccaaggtcaacaggatgctgtgttattattattatgattatttttgcatcaggacttgtgggatctgtagtaactattctcttggccaattataatcacatcactggcattgttttacgagaaatagccccgctaggcccagtcagcaataagtctttggagctgtctcagcctgcagttgctttatataaaccatcccttttatgggagttgaagcactgtatgaaaagggtttttgtctcatgttgaccttgtttagtcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgca

SEQ ID NO: 156804 - DNA, 678 bp, Homo sapiens
  Payload ID: 10735
  Gene Symbol: MYLK
  Gene Name: myosin light chain kinase
  Uniprot ID: Q15746
  ENST ID: ENST00000583087
  CDS Start-End: 173-637
aagcactgtatgaaaagggtttttgtctcatgttgaccttgtttagtcacattaacgcacacatcagttccaggccccattccattctctgaacatcttctgacacactgacagtgctgagcagagcaagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaag

SEQ ID NO: 156805 - DNA, 1447 bp, Homo sapiens
  Payload ID: 10735
  Gene Symbol: MYLK
  Gene Name: myosin light chain kinase
  Uniprot ID: Q15746
  ENST ID: ENST00000578202
  CDS Start-End: 221-682
agtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaa

SEQ ID NO: 156806 - DNA, 2787 bp, Homo sapiens
  Payload ID: 10736
  Gene Symbol: MYLK2
  Gene Name: myosin light chain kinase 2
  Uniprot ID: Q9H1R3
  ENST ID: ENST00000375985
  CDS Start-End: 105-1895
ctcctgagcagccgctgggagacagacggcaaccaggttgcccctctttgctccagctagaaagacttgagttagacaagcagcagcacacgcctccctacctcatggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtgg

SEQ ID NO: 156807 - DNA, 2956 bp, Homo sapiens
  Payload ID: 10736
  Gene Symbol: MYLK2
  Gene Name: myosin light chain kinase 2
  Uniprot ID: Q9H1R3
  ENST ID: ENST00000375994
  CDS Start-End: 274-2064
actgcccacacccctgcctccgcctctgcccacccggcccaatcccttacaactgcccaggactgctcctgagcagccgctgggagacagacggcaaccaggttgcccctctttgctccaggtacctctctcccctcagttagcaggcctcggcttcctgtctcactgcagccagacgagaggggaaattggacagcctgacacactccactcttgtttctgcagctagaaagacttgagttagacaagcagcagcacacgcctccctacctcatggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtgg

SEQ ID NO: 156808 - DNA, 6911 bp, Homo sapiens
  Payload ID: 10737
  Gene Symbol: MYLK3
  Gene Name: myosin light chain kinase 3
  Uniprot ID: Q32MK0
  ENST ID: ENST00000394809
  CDS Start-End: 117-2576
aggagtctgtcagctacggaggacaatgaccttgcagacaccaccgcctgagtgagaaccaggggtctgtgcctctcctcattccccgctcttgcccttgtcaagcctgcaccagcatgtcaggaacctccaaggagagtctggggcatggggggctgccagggttgggcaagacctgcttaacaaccatggacacaaagctgaacatgctgaacgagaaggtggaccagctcctgcacttccaagaagatgtcacagagaagttgcagagcatgtgccgagacatgggccacctggagcggggcctgcacaggctggaggcctcccgggcaccgggcccgggcggggctgatggggttccccacattgacacccaggctgggtggcccgaggtcctggagctggtgagggccatgcagcaggatgcggcccagcacggtgccaggctggaggccctcttcaggatggtggctgcggtggacagggccatcgctttggtgggggccacgttccagaaatcaaaggtggcggatttcctcatgcaggggcgtgtgccctggaggagaggcagcccaggtgacagccctgaggagaataaagagcgagtggaagaagagggaggaaaaccaaagcatgtgctgagcaccagtggggtgcagtctgatgccagggagcctggggaagagagccagaaggcggacgtgctggaggggacagcggagaggctgccccccatcagagcgtcagggctgggagctgaccccgcccaggcagtggtctcaccgggccagggagatggtgttcctggcccagcccaggcattccctggccacctgcccctgcccacaaaggtggaagccaaggctcctgagacacccagcgagaacctcaggactggcctggaattggctccagcacccggcagggtcaatgtggtctccccgagcctggaggttgcaccaggtgcaggacaaggagcatcgtccagcaggcctgaccctgagcccttagaggaaggcacgaggctgactccagggcctggccctcagtgcccagggcctccagggctgccagcccaggccagggcaacccacagtggtggagaaacacctccaaggatctccatccacatacaagagatggatactcctggggagatgctgatgacaggcaggggcagccttggacccaccctcaccacagaggctccagcagctgcccagccaggcaagcagggcccacctgggaccgggcgctgcctccaagcccctgggactgagcccggagaacagacccctgaaggagccagagagctctccccgctgcaggagagcagcagccccgggggagtgaaggcagaggaggagcaaagggctggggccgagcctggcacgagaccaagcttggccaggagtgacgacaatgaccacgaggttggggccctgggcctgcagcagggcaaaagcccaggggcgggaaaccctgagcctgagcaggactgtgcagccagggctccggtgagagctgaagcagtaaggaggatgcccccaggcgccgaggctggcagcgtggttctggatgacagtccggccccaccagctccttttgaacaccgggtagtgagcgtcaaggagacctccatctctgcgggttacgaggtgtgccagcacgaagtcttgggagggggtcggtttggccaggtccacaggtgcacagagaagtccacaggcctcccactggctgccaagatcatcaaagtgaagagcgccaaggaccgggaggacgtgaagaacgagatcaacatcatgaaccagctcagccacgtgaacctgatccagctctatgacgccttcgagagcaagcacagctgcacccttgtcatggagtacgtggacgggggtgagctcttcgaccggatcacagatgagaagtaccacctgactgagctggatgtggtcctgttcaccaggcagatctgtgagggtgtgcattacctgcaccagcactacatcctgcacctggacctcaagccggagaacatattgtgcgtcaatcagacaggacatcaaattaagatcattgactttgggctggccagaaggtacaagcctcgagagaagctgaaggtgaacttcggcactcctgagttcctggccccagaagtcgtcaattatgagtttgtctcattccccacagacatgtggagtgtgggagtcatcacctacatgctactcagtggcttgtccccatttctaggggaaacagatgcagagaccatgaatttcattgtaaactgtagctgggattttgatgctgacacctttgaagggctctcggaggaggccaaggactttgtttcccggttgctggtcaaagagaagagctgcagaatgagtgccacacagtgcctgaaacacgagtggctgaataatttgcctgccaaagcttcaagatccaaaactcgtctcaaatcccaactactgctgcagaaatacatagctcaaagaaaatggaagaaacatttctatgtggtgactgctgccaacaggttaaggaaatttccaacttctccctaatcttcaactctgctgctccaatgggtccagaaattactgaggccagtggtgaagtgaagagatgactcaaacatttaaataatttggctttttggtattattgattccacttattttgtaaaaatggttatggctgctgccttccttgtggatgaaaagtggctgtaaagaagcttcctaagaacgtttttttctgccttgtaagatcactacgtgtgaaatgctctgagtacctttcaaatatacctacttttggtggtaagtgtagggatgctttaggtaggtactttgcatctgtcgaatttaaattctaaactcacactgattaaggaactcagtagactactttgcaggggccatgttattcagtgttatctcctccagtacaaagaattcctagaattttgatttgctcaggtgtgagctgacattttattgtactaccccattcttgtgttaagccatgtggatttaggacagtgatcttcaaacttgctttaacttatgctcccttttgagaatcagcatcacttgaaatgtcaaaatatgtcaactctcatagccaaatcaaagaagtgatcattttgactgtgctttttaaatctccacacacctccacctctctcctaattctgcctgtcttaacccctctgtcttagttataaatttctggtcttgtaagtctggaagctgataggcaatttatgaaagagataagaatgtaatgaggttccgctttctgagaaacacagaaatgatacatcctgagacataaaggaaagctgctcttctgctgcctcaggctgtagcactctcaatgttgtcactctacacatacactttctatatacatgtacagttgacccttgaacagggtttgaattgcagtcaacttaaatgtggattttctttcacctttgtcacccctgagacagcaacaccatgctctcctcttcatcccactctgcagcctactcaacaggaagatgatgaagatgaacacctttatgatgatccactttcacttaatgaatagtaaacatatgttttcctccttatgattttagtaacttttctctagcttactttattgtaagaatacagtatataagctgggtgtggtggctcatgcccataatcccagcactttgggaggctgaggcaggcagatcacttgaggtcaggagttcaagaccagcctggccaacacagtgaaaccccatctctactaaaaatacaaaaattagtggggcgtggtggcggatgcctgtaatgtcagctactctggaggctgaggcaggagaactgcttgaacctgggaggtggagtttgcagtgagccaagattgcaccactgcactccagcctaggcaacagagcaagactccgtctcaaaaaaaaaaaaaaaaaagaatacagtatatgtatatatacacacacacaaacacacacacacacgaacacatatgtgtgtatgggtattaactgactgtttatattattgatagggcttccagtcaacattaggctattagtagttaagtttttggggagacaaaagttatactcagattttctactgcaagggggtaggcactcctaaccctcacattgttcaagggtccactgtacatttaaacacttttctatatgcattagagtagccctgtcatcccttcactgaaatcatactgttctcaacatggcaagcaactaacacttttttttttttttgagacagggtctcactctgttgcccaggctgcagtgcagtggtgtgatcttggctcactgtagcctccgcctcctgggctcaggcgatcatgagtacctgggaccataggtgcccgctactacacccagctaatttttgtatttttagtggagatagggttttgccatgttgcccaacctggtcttgagctcaagcgatccacctgccccagcctcccaaagtgctgggattataggtgtgagccaccacacccagcttcaactaacacatttacgaacttgtatacatgtatatttagatactttaccaacttgtaaaatggttaaaggagtactttattatgaaaaaatatacaatctttaaaatttccttacttctacatgatttttgtgctattcccatttttttcctcaggtgagcagctttagttttttattttttttgagagagtcttcctctgtcacccaggctggagtgcactggtgtgttcttggctcactgcaacctctgcctcccgggttcaagtgatcttgtgcctcagcctcccaggtagctgggattacaggcgtgtgctgccacgcccagctaatttttgtatttttggtagagatggggttttgccatgttggccaggctggtctcgaactcctgacctcagatgatccacctgtcttggcctcccaaagagctgggaatataggcatgagccactgtgcttggcctcaggtgagcagctttagtcaatgttgtgaattttagattttaattagacatgcaacagtttcactacctttcaggatttttgtcctgtaacagaggctcttgctttttgacagagaggtaggcaggtggagaggttatcctgctgctgcagttctcaagttgttaagtttcctctggaaggctaacccttgttgggaactaacagtttcaataccagcaagtctaggcctgctccaagttggtcagctgaagaatgaacatcagaagacacagctgctgaaagttgtcctttgatgagacagtgatagtgatttggtaaaatgtcttattttttaaatgtcagttatctttctttaaaaggttttttgagggcagcctccagaaggagctagagagtatattttatagttctattgtggttcataccctgttttcgacttaagattctggagaatgctatgaaacatctccccagaaaaagacagttaattaccatatctagagcagcactgcccaacaaaaatatagtacaggctatacacataattaaaacatttctagtagcttctctaacaaaacccattgaaagccaattttaataatttatataacttagtgtatcaaaaatatttcaatatgtaatcaacataaaattgagatactttaccagctactagggaggctgaggccagagaatcacttgaacccagggggtggaggttgcagtgagccaagatcacaccattgaactccagcctgggcaacaagagcaaaactccgtctcaaaaaaaaagagatattttatattctttttctcatactaagtctcaaaaatctggtatattttacacttaaaaacacatgtcaaggctaggcatggtggctcacatctgtaatcccagcactttgggaggccaaggtgggcagattgctggccaacatggtaaaaccccatctctaaaaatataaaaattagctgggcgtggtggcgcatacctgtaatcccagctacttgggaggctaaggcacaagaatcacttaaacaggaggcaggggttgcagtgagctgagatcacaccactgcactccagcctgggtggcagagcaaaactttgtccccacccctgacaaaaaacaaacaaacaaacaaaacaaaaaaaaacctgtcaattcagatgctaggttttcatcagacgtacttaatctgtatttagatttcttaaaacttactgtggaaaatgtatttacatactcaagttgtttgaaacataactcactgttttccaataactgaagtatccacttttacatgtattaaaattaaataaaattagaaattcagttctgcagttgcactagccacattttaagtgtttaatagccacacgtggttagtggcatctatattggacagggcagatctagagagaatcctgtatctaacaattttaatttttttccctttatgctgttattccttacctagagaaacaatttccctccaaagttcctttgaggggtctgtttaggccaggccaacacaagtgacctatgtggattttagcatcctttttttgaaatttgaggttttatgaagcttgagtttttctggatatttttagtaatttgctggtgtgtacttagctcaaatacttgattgcaactgtgttgggtcaactatttctaatgggacttttccatttgcatgtacagtcactggaaactgctgggcagagaaactctaaaaggtagttggggcacactttttccacctgtcagattggtgaagaattggtgaggctgtggggaaaatggcattctcccacttttgatggatatgtatccaaataaaagtcattcccatgctttctttcatcc

SEQ ID NO: 156809 - DNA, 1795 bp, Homo sapiens
  Payload ID: 10737
  Gene Symbol: MYLK3
  Gene Name: myosin light chain kinase 3
  Uniprot ID: Q32MK0
  ENST ID: ENST00000536476
  CDS Start-End: 321-1757
agagggccgaccagcagaggaagggagaccagagggcagcttgcacagatcttgtcttgggttataactgttgacaagccacttaactgcctccaggtttaagtttgtctgtgtataagatggaggtaacaatatttatacatctcactggagacttatgaaaacaagattttggacagatcccttgggacccatggatggaaagtgaataaagagcgagtggaagaagagggaggaaaaccaaagcatgtgctgagcaccagtggggtgcagtctgatgccagggagcctggggaaggatctccatccacatacaagagatggatactcctggggagatgctgatgacaggcaggggcagccttggacccaccctcaccacagaggctccagcagctgcccagccaggcaagcagggcccacctgggaccgggcgctgcctccaagcccctgggactgagcccggagaacagacccctgaaggagccagagagctctccccgctgcaggagagcagcagccccgggggagtgaaggcagaggaggagcaaagggctggggccgagcctggcacgagaccaagcttggccaggagtgacgacaatgaccacgaggttggggccctgggcctgcagcagggcaaaagcccaggggcgggaaaccctgagcctgagcaggactgtgcagccagggctccggtgagagctgaagcagtaaggaggatgcccccaggcgccgaggctggcagcgtggttctggatgacagtccggccccaccagctccttttgaacaccgggtagtgagcgtcaaggagacctccatctctgcgggttacgaggtgtgccagcacgaagtcttgggagggggtcggtttggccaggtccacaggtgcacagagaagtccacaggcctcccactggctgccaagatcatcaaagtgaagagcgccaaggaccgggaggacgtgaagaacgagatcaacatcatgaaccagctcagccacgtgaacctgatccagctctatgacgccttcgagagcaagcacagctgcacccttgtcatggagtacgtggacgggggtgagctcttcgaccggatcacagatgagaagtaccacctgactgagctggatgtggtcctgttcaccaggcagatctgtgagggtgtgcattacctgcaccagcactacatcctgcacctggacctcaagccggagaacatattgtgcgtcaatcagacaggacatcaaattaagatcattgactttgggctggccagaaggtacaagcctcgagagaagctgaaggtgaacttcggcactcctgagttcctggccccagaagtcgtcaattatgagtttgtctcattccccacagacatgtggagtgtgggagtcatcacctacatgctactcagtggcttgtccccatttctaggggaaacagatgcagagaccatgaatttcattgtaaactgtagctgggattttgatgctgacacctttgaagggctctcggaggaggccaaggactttgtttcccggttgctggtcaaagagaagagctgcagaatgagtgccacacagtgcctgaaacacgagtggctgaataatttgcctgccaaagcttcaagatccaaaactcgtctcaaatcccaactactgctgcagaaatacatagctcaaagaaaatggaagaaacatttctatgtggtgactgctgccaacaggttaaggaaatttccaacttctccctaatcttcaactctgctgctccaatgggtccagaaattact

SEQ ID NO: 156810 - DNA, 5806 bp, Homo sapiens
  Payload ID: 10738
  Gene Symbol: MYLK4
  Gene Name: myosin light chain kinase family, member 4
  Uniprot ID: Q86YV6
  ENST ID: ENST00000274643
  CDS Start-End: 344-1510
gatcaagagccatattaatttaaacaggggctgaaagtggcatttgagagagaagatacttcctctcgtagtggacacttgtcttttcagaagatttatacgactgagagtcaaaacttttaccagagactttcatagtcagtttgaattctgcaaaatttctctttatcttctggaatgtatgctctagacttggagtggctcaagctcttcgatgtgatcctatcaatgtcaagagaaagaagcactgaagagtcataattgtgtcctgatttataaatcggagacagagggagacgaaaaccacactccagaaagtagcttaatcggactcactactaagatgttaaaagtgaagaggctggaagaattcaacacgtgttataacagcaaccagctggagaaaatggccttttttcagtgcagggaagaggtggagaaagtgaagtgttttctggaaaaaaattctggggaccaggattcaagatctggacataatgaggcgaaggaggtgtggtcaaacgccgacctgacggaaaggatgcccgtcaaaagcaaaaggacatcagccctcgcagttgacatcccggctcctccggccccatttgatcatcgtattgtgacagccaagcaaggagcggtcaacagcttctatactgtgagcaagacagaaatcctaggaggagggcgtttcggccaggttcacaagtgtgaggagacggccacaggtctgaagctggcagccaaaatcatcaagaccagaggcatgaaggacaaggaggaggtgaagaacgagatcagcgtcatgaaccagctggaccacgcgaacctcatccagctgtacgatgccttcgagtctaagaacgacattgtcctggtcatggagtatgtggatggtggggagctgtttgaccgcatcatcgatgagagctacaatttgacggagcttgataccatcctgttcatgaagcagatatgtgaggggataaggcacatgcatcagatgtacattctccacttggacctgaagcctgagaatatcctgtgtgtgaatcgggatgctaagcaaataaaaattattgattttggattggccagaagatacaaacccagagagaagctgaaggtgaactttggaaccccagaatttctcgcccctgaagttgtgaactatgattttgtttcatttcccactgacatgtggagtgtgggggtcatcgcctatatgctacttagcggtttgtcgcctttcctgggtgacaatgatgctgagacgctgaacaacatcctggcctgcaggtgggacttagaggatgaagaatttcaggacatctcggaggaggccaaggagttcatctctaagcttctgattaaggagaagagttggcgaataagtgcaagcgaagctctcaagcacccctggttgtcagaccacaagctccactccagactcaatgcccagaagaagaagaatcgtggctctgatgcccaggactttgtgaccaaatagtctacaggaggcagccatttggaaggaaaactgctgtggttgctgctgcttcgagaaaattttttgaaaaatcagcagttctgatgccttgacccctgtgatgacctggtagtcttagcagggggagccctcgaccctgaatgtgaacttgaactggagtgcctctgctgcgctcagaggaacacccagcgctgcggtctggtctcagggcgcaaacacatccctgcacccggtggtggtgatgttgggaagatgtttccctgccatcttgagattttttacttttttaaaaaaattttttgatcttagtcactggggcagggggtgcattatgtctgccatttctcaaatgactacagctgtgacacttaagattgattggagattttaaaactggaggatgcatttagagggagaaagctacttccagccattagactatgcctttggaaggggcaattagatggccagaaagaattctgactcccatgcacccttggagacttagtttcacagactctgtcattttgatttggtctgtggtcacgtgactacaatggataaataatttgtttgctggaacagaagccgtctttgaattctccaacaagaggcatcagccactgtgtctttcatttattctgaattgtccccagcgtgcgttttcttccatgtagctgattctgtttttcacatctatactccctgcacccttctgactgacagttcatccccacaaaacacattggttttgagaggtgatgcaaaaagtatctgtttatggttggactttgaaattctgacctttgaaataatgtcaacagtcacaacaggtttcctcaagccccatttgtcaactaaaagagacggatctgcacctcctggagcaagatagcactgagctttcaacattgaagtgacttgggaaataacattcaagcttctgggtaaacacatacaaacagtggcaaagaccaagtacagtctctcgcctgtgctgtctcatgggactcaatggtggtgaagaaatctcaatcggacaccagaggtgggggcaactctgcaagctcacctgctggacgtgagaatgttggaacgttccagttggaaggttcctatgcctagcctgtgtgccatttcatggcagatatgtaagaaaggaaatggccctactgtagacagcttatggggcccagaaaggcactgggctttaaagagcgaaatgagtgtgtcatttccacatgaaggagaggcaaggaaaagccccacaaaattcctgttacccgctgaactccaagctcaccaaccagattcatgagctttctcacattttccatttccaaataactgttgtgttgaatcagctgtgttaatgcctttattctttgttttttttttttagacggagtctcgctctgtcacgaggctggagtgcagtggccccatctcggctcactgcaacctccgcctcccaggttcaagcgattctcctgcagcctcccgagtagctgggattacaggcgcacgccaccacgcacggctgatttttgcatttttagtagagatggggtttctccatgttggccagaatggtctcaattactgttgtcgcaatagcaatgaaaggcataagaattacttggtggcctcatgagggatggcagtttcactttgcatcagctttcccccattatctctcagatccacttaaggaatccttacagcatgccgtgaatgtgtgcaacatccttattctcatctttaaggtaaggaggaagtagagatagaaggaaatacgtgatttggtgaaggccacatgcgaattttgtggtcgtgttagttataaaactgactcctttccagcctttgctcttacattatgatgcgtttctttttctcctttggccttgcatttatccgaggttggtttcttatgttcctgtgatgtgactatgcttaagtgtttaatttagtttgcttaaaacacacacaccacacacacacacacacacaaaaccctgtgactggagtgttatattactatgctatctttagctgatgatattcattgagcctggaaaaatacaagccagtgcatgcattaatacttagttagaccgcagagagctggcattcactcaaatgctaaacaggacacaggggtctgatttgaagcccctcgtggcagggcgttttctgtcctgtggtgtgcattctctaccaaatcaagcaggagatcttttgcacgacgtgcaatttgcatccaccttcccttctgactcaggttggcagataaactgtccccagaccctgccacacatggaagagacagctcaggccaaatacaggcatgatttctttgccaagttaatgcactgatgaccctgcagtgagtgggtgtgatttttgttttgttttgaggtttagaaaggagactgtactttgaaaatggatcttgtttgattctgtagttaaatttccacatttggaatgggaaggcatctccatgccagcagggtgccttttatatgagtgctgagggtagtttgcattgcagagttcatgattacagtctagagttacttgaaatgggagattatcagtctagtgttcatcccgcccctgctccatgtccttgtgtggctgctccagcgagagctggtaactaggtagactgctgctctaatggggaaagggggctttgcaaagccgaggaatcaagccagatgcgagcatggactcagaaaagctgagtctggctagaccagggctatggagatcaatttttccaacaggtcattaggatttgggaggctgtatttctcctccaccctcttaatggatggtatggctttgctcactcactaggcagttcccactttctttagcaaatggaggaaattaagcaccgatgtagcacttcccactgcctggagagaaataaacctcgcaagttattaaggagaaggcatgcctcattggtaatttggaagacaccaacacttacccagaatctgttgctatttaaaaatcagggagaggagggcacatgtccccatttgctacattacaaactttggacgagactctcatctgaactaacttggggaaacaatttctaggttgaagctggtaacactcatgtctgttgagtgccataagtttgttttcagttatttcctctaacttgatattaatttgctttctttcctcaaaaatgtaagtaggcatgttgccattgttgtggcttgctttgatgtatgtttggaaagatgtgtgaatacttaatttttatccattttatggaaattagcttagcaatttttttttctcttttaagaatcaaaatatggatttgatactaggaacagaatctgctctttatttcattccttttttgtctcttctgcttcctctgcccctcccccagccacgcagcacgggtgccagtgtgcatgcgtgtgctgggggccaaatgacagaaccccggttgaaagtccgcttgtaaaagcacaagtgagaggcagcatcaggcccctggagggctgtggtcctcggactcggttctttcctgtcccctggccgtcctgtcatccctgtgtgctgcagcatcaccacggcctacttcccaatatccacaaagcttcgcctttgcttttgcactctcttttacatttttttacttctttcctttttcttaagttcggatccaagtttgtcttcttatccatcaccatgctccctgaaagcctttttgagattaagaaattttcttaccaggaggcaactttccgtctgtcctaaagggaagtgggtgctggatttattagatattgggttcctggattaagatgacttcctcacatagcttggagtctgcagtttctcagttagaagtgttctatatttctttttgctccattttagtgcgctgtgctttgtataagtggtctttctatgggcagtttcaccttccatgaaggcttataactcaaccactactacccattcagaagagcagaaagcatctgctgtgtgagcgttcatatgttacctaatgtgtattttgctgtcgtctcagctgatagatgtcagtgagtctttctgactaggtttattggtgttgataagaaattaaaaaaaggattcataacgtggtgattgtgtctatcatgtatattttaaatttctgaacgtactttcatttagctgtttttctttgctttctaaagatgtataacaatcatgtatatgtattatattgaagaataaacatggaccttatttatcttttga

SEQ ID NO: 156811 - DNA, 682 bp, Homo sapiens
  Payload ID: 10739
  Gene Symbol: MYLPF
  Gene Name: myosin light chain, phosphorylatable, fast skeletal muscle
  Uniprot ID: Q96A32
  ENST ID: ENST00000322861
  CDS Start-End: 82-591
aaccccagagggactgccccatgctgactccttgcttctttccagccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttctta

SEQ ID NO: 156812 - DNA, 602 bp, Homo sapiens
  Payload ID: 10739
  Gene Symbol: MYLPF
  Gene Name: myosin light chain, phosphorylatable, fast skeletal muscle
  ENST ID: ENST00000563718
  CDS Start-End: 247-602
atttaggcggtgacagacagcatccgcagtcaataggaagagctgaagaattctttaggtctcccaaaatggcctttgctcaggccatgccctccgcccagcacatctgctcctccacctgcacctgactccctggccctcgtgaagccactcccatactcctagacagggctgctgcgccctccacttctgggctcctgaccagctctgccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagtt

SEQ ID NO: 156813 - DNA, 623 bp, Homo sapiens
  Payload ID: 10739
  Gene Symbol: MYLPF
  Gene Name: myosin light chain, phosphorylatable, fast skeletal muscle
  ENST ID: ENST00000568749
  CDS Start-End: 219-623
ggtggctggggcctcagtgcccagaaaagaaaatgtcttagaggcctttgctcaggccatgccctccgcccagcacatctgctcctccacctgcacctgactccctggccctcgtgaagccactcccatactcctagacagggctgctgcgccctccacttctgggctcctgaccagctctgccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggag

SEQ ID NO: 156814 - DNA, 604 bp, Homo sapiens
  Payload ID: 10739
  Gene Symbol: MYLPF
  Gene Name: myosin light chain, phosphorylatable, fast skeletal muscle
  ENST ID: ENST00000566955
  CDS Start-End: 1-600
gcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggaggtgagtggggaccggggcggggccggagcagcaaaggggctggggccggggagactaagggcctgtgcgagacgcccctacgtctttccccagatcaagaacatgtgggcggccttcccccccgacgtgggcggcaacgtcgactacaaaaacatctgctacgtcatcacgcacggcgacgccaaggaccaggagtaggggc

SEQ ID NO: 156815 - DNA, 6050 bp, Homo sapiens
  Payload ID: 10740
  Gene Symbol: MPRIP
  Gene Name: myosin phosphatase Rho interacting protein
  ENST ID: ENST00000313485
  CDS Start-End: 1-5384
agcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcagactgaagtggccgcctccccatcgggtgcctggcagaggctccatagagtcaaccaagaccttcaaagtgagcttgaagcccagtgccagcgccaggagctgattacacaccagattcagaccctgaagcgtagctatggggaggccaaggacacgatccggcaccacgaggctgagatccggagccttcaggcacggctcagcaatgcggccgctgagctagccatcaaggagcaggcgctggccaagctcaagggcgacctgaagcgggagcagggccgggtccgcgagcagctggaggagcggcaacacagcgaggcggcgctgagcagccagctgagggctagcgagcagaagctcaagagtgctgaggccctgctgctggagaagacgcaggagctacggggcctggagacacagcaggcgctgcagcgggaccggcagaaggaggtccagaggctgcaggagcgcattgccgacctcagccagcaactgggcgccagtgagcaggcgcagcggctgatggaggagaagctgcagagaaactatgagctgctgctggagagctgtgagaaggagaagcaggcattgctgcagaacctaaaggaagtggaagacaaggccagcgcctatgaggaccagctgcagggtcaggcacagcaggtggagaccctgcagaaggagaagctgagcgccactttcgagggcagtgagcaggtgcaccagctggaggagcagctggaggcacgagaggccagcgtgcgcaggctcgcagagcacgtgcagagcctctgtgacgagcgggacctcctcagacagcggttccaggagctgacagagcgcgtggccacgtccgacgaggatgtggctgagctccgggaaaagctgaggagaagagaggctgacaaccagagcctggagcactcctaccagagggtctccagccagctgcagagcatgcacactctgctgagagagaaggaggaagagctggagcgcattaaggaagcacatgagaaggttctggagaagaaggagcaggacctcaatgaggctttggttaaaatggttgccttggggagcagcttagaggaaacagaaattaagctccaggcaaaagaagagattttaaggaaatttgcaagtgaatctccaaaggacatggaagagccacggagtacccctgaagagacagaaagggatggcactttgctcccaggccaaccagtccaagccactagggcacctctaggcctcccacacacaaggctcgaggatgaggacgaggacctgggggctcctccgggggaagagtacggtgatggcagccccagtagggaagacagcatggtgcccccaaagtcagtggaagtgcttgacagggagggccatcagcagggcacagccaaactcgaccaaggggcacctggtgttaaaaggcaaagaatccggttctccacaatccagtgccaaagatacattcaccccgaagggtctgagaagacctggaccagcagcacatcttccgacaccagccaggaccggtcaccctcggaagaaagcatgtcctcagagcctgcacccagtgtactgcctgcaactggcgactctgacacgtacctctccatcatccactccctggagaccaagctctacgtcacagaggaaaagctcaaagacgtgaccgtgaggctggagagccagcagggtcagagccgtgaggcactgctcgcactgcaccaccagtgggcgggcaccgaggcccagctgcgtgagcagctccgcgccagcctgctccaggttggcgcactggcctcccagctggagcaggagaggcaggagagggccaggagggttgaagggcatgttggagagcttggggacttccaggtcaagaatagtcaggccctgatgtgcctggaaaattgccgagaacaactgagatctctgcctagggccagccaggaggatgagcaggacgcacgcgcagcctccctggccagtgtggagagtgcactcgtcagcgccatccaagccctgcagcactggccggccccagcccatggcggggcccgtgcacagctggagacaggtggcaccgaggagaatgggaagcctgcctccctgcagcagtgctcccagtctgagttgacagagcaggagcaggtgaggcttctttctgaccagattgctctggaggcctcgctgatcagccagatagcagattccctgaagaacacaacatcagatgtctcccgaatgctccatgagatttcttggtcaggacagccaccgatggaatctgctggggcccccgtagacacctgggccaggaaggtcctagtggatggtgagttctggagccaggttgagtctctgaggaagcacttggggacactgggaggagaggcagtcggtgcctcaggagacgggcagcaaagcatcccacagggcctggcccccatcctggccaatgccacatgggtcagggcagagctcagctttgccacacagtcagtgagggagtcgttccaccgcaggctacagagcatccaggagaccctgcggggcacccagacggccctgcggcagcacaaatgcctgctgagggaaatcctgggagcctaccaaaccccagactttgaaagagtgatgcagcaggtcttggaagccctcaggcttccagcgggccatgaagatggtgttcagctgtcctgggacctgagccccttaggagaagtcctgggccgagactcagacagctctcaggagcccttcgatgtgtctgaccagagccctggggcctttgttgctattcaggaggagcttgcccagcagctgaaggagaaggccagcctcttagaggagatagcggctgccttaccatctctgccacctgtggaatcgctgagagattgccagaagcttctccaggtgtcccagagtctctcgtataacacttgtttgggaggcctcggtcagtattcttcattgttggttcaggatgccattattcaggcccaggtttgctatgcgtcctgcagaatccggctagaatatgagaaggagctccagctctgcaaggagtcctggcaaacccgggagccctcctgctcagagcaggcacaggcagcccgggccctgagggaggagtatgaggagcttctccgcaagcagaagagcgagtacctggatgtgatcgccattgttgaaagggagaatgcagagctcaaggccaaggccgcccagctagaccatcagcagcagtgtctggaggatgcagagagcaagcacagcatgagcatgttcaccctgcggggcaggtatgaggaggagattcggtgtgtggtggagcagctgaccaggaccgagagcacactgcaggctgagcgcagccgggtcctgagccagctggatgcctcggtcagagacaggcaggacatggagaggcatcatggtgagcagatacagaccctggaggacaggttccagctcaaggtccgggagctgcagacgatccacgaggaggagctgaggaccctgcaggagcactactcgcagagcctgaggtgccttcaggacaccctctgcctccaccaggggccacaccccaaggccctgccagcccctgcccccaactggcaggccacccagggagaggctgactccatgacggggctgagggagcgcatccaggagctggaggcccagatggatgtcatgcgggaggagctgggacacaaggacctggagggcgacgcggccacactgcgtgagaagtaccagagggacttggagagccttaaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 156816 - DNA, 3846 bp, Homo sapiens
  Payload ID: 10740
  Gene Symbol: MPRIP
  Gene Name: myosin phosphatase Rho interacting protein
  Uniprot ID: Q6WCQ1
  ENST ID: ENST00000341712
  CDS Start-End: 1-3078
atgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 156817 - DNA, 527 bp, Homo sapiens
  Payload ID: 10740
  Gene Symbol: MPRIP
  Gene Name: myosin phosphatase Rho interacting protein
  ENST ID: ENST00000395806
  CDS Start-End: 90-281
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcagcaaaacacccacccccttgaaatgaaacgtggagctcacatatatgatgcacgaatgttctcatgttgaaggacaggaagaggaatggcatcagctatgagaccaccctgacccccacccgctgccccatcctacacccgaggtggcccctgaagcatgacctccagggatcttcacagtttgaagagccgctgatatactctaatacttgcagtaatattttttaatagaatgcaatattggatgtacacaaaaggatacaagcagcatacatttacaatataaatctaaataataaaaatgaatgctcgtgaa

SEQ ID NO: 156818 - DNA, 10960 bp, Homo sapiens
  Payload ID: 10740
  Gene Symbol: MPRIP
  Gene Name: myosin phosphatase Rho interacting protein
  Uniprot ID: Q6WCQ1
  ENST ID: ENST00000395811
  CDS Start-End: 90-3206
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaatccccggcccctctccttccttccttccttccttcctccgctcgttcctttcttggtctccagtaaccctggtcttttcataactgctcgagattgttgacctgcagcccaggtttcagactctgattgcaaaaaacaaatgaattccccccaggaatcattcaaaatgggggaaggtttgggggtttgggttttttttttaccttttggaaaagaaaccgtcacattgctttggaaaaggttgagaggagacccctgttaagtcaagaagaaagtacagaggatgtcagaatctgatgagaacagcacattagtgtttattgagactccgatcttaactctcatttaattaatctgagctctgaaaacctatcttgcagcatttatctttaaaagagcctggttaaagtaaacctatactaacaattttgctttttctaacagtttgaggaagacctttttaaccaccacaaaacattctatggcaattcttgaaaatctcttaaattggagtctattatggccccatgaaaaccattaatcccattaagatagggagtataaacccctggctggtggaacaggttctgctactttaggagcaaggtggggtgtgagtagatggttttcatgccaagaacatgctttcactttgtattcatgcttgtgttggtgtgatggtctctgtgggtgggtggatgctttgggcgttgaaatctagaaatcctgttgctcagtttctagatgaagtcatgagcaaggccatcagtggagctctggccccgcccccaatgtgcagaagggccgggagcaaggcctggagttttcatgtgttttcagacccaggtttaggtgctctcttctcactgaaataactaagtgctctccactggcatcgagccctttccacaagtttttaaggctcttaacccacactttcactcctctgctactagtcttcagtgttgttaacagcaagagaaaattgggtttgtttaaaaatctacttctctgaggtggcacagttgcgtagctgtagtcccagctactcaggaggctgaggtagtaggattgcttgagcccgggaggtcgaggctgcaatcagtcatgatcgtgtcactgcactccagcctgggtgacaaagcaaggccccatatcagatatagatatacttatcagaccccccctgaccatttagattggcagtgctttgagaaatgcactatgacctttctgtgtcaatgggaatatacagaaggaacattcgggaccccgctgtcccccacagcctcattgttgtctccaggacactgctgggtcacacgaatgctccaggacagacagggacctggagtgcatcaggatctgaccagataggagtttttgcctcgtgtctgggtgctacgattttgtgccgttctctgaggtccaccacctgcccttcctggcatggtttccttcgtgaccatccctgctgcccctgggggtggaccccactggcccttctgcagacagctccctgccttctgccctccagggggttctggccagagtccatgcttggagacaggatcatctgccttcagccctcacagtgctttaaattaaagcaagtttgcccataggacaaaagagcatttgattcccttttttctgtcacatatcccttgaggctggacttcaggaatcctggaaaattaatatgagtgcagcatgtgaggggtcagagacaggccagcagggcgtctgcattcctccctgccacaggtctctccccagaggctggtttagtgtagggtattgccaggaaacggactgaggctgctttgctaagagctcctgaaaatgccctgggcctgtcctggcgtttctgaagagccctcatacagggacagccaccatctgggtcaaggaagtctgggttccctgctggtgggctccatcctgcgatggagtgaaccaggcgagaaaggatgacgatgttcttcatgttgcacctggacatgccccaggaacagagacttgcccaggtggcaacactggcacagatgttgacggctgcccaactggtgccacactgagcagggagccttgtgctgcacagggctgggccctctctccagtttccttcctgcaggcatccaaataccctggaagggatttaacccctgaattccagagggaagaaagaagaacagtgaagaagtagaactggtttctgtatggggagaggaaagtcttagggacagctgcaggcggggtctcaggctgctccttggcaccagctacacagtagtgagctttcccagctttaccgatgaggaagaagttcaaatagatagacttcagcattttaattattttcctataaatgtatttatgtgtagtatgctagcaccagccagtaagctgtgccacacatatgaatgggaaagcgaggcagttgtgctcgtgtgagtttctgcaggcttgtgggtaattaccttgtgtgcacgcctgcacgtgcagaatagtcactttctgctggtcagtttctttatccacccatggtgccccagccccaggcaggtgtggagaccagcatttcagaggacgcgctgtccacagcctcccgggtctgagtggatcattgggcaggggtggagacagtgcgctgccctctgagctggaagcctgtgcttcagggagtcataatgggcctgtgctaagtgggtgatgcagtggacatcccagggcgactagaggtggcagtatcgcgaatttgcaggtttattgaacaagaggtaacatcggagaggatcttgccttcggattcagcaagtatgaaggcagaagagcatggagagcaaggccccacagcctgcttagtgagttggaaggcccagcaagaacctgtttctgcagcagccaccagctcccatcaccccttgaccctccagctcatgctggagaagagggaattttggctgtttaaagaacacagttgtgaatctcagaatgtgcctgaaaggaatactgacagataaggccggaaacaaaactgatggcttgaaaaacatttttatggaatgtatttactatcattttgttttactatagaggtagatgggactcttaacttttgggtacatggaaacatgctgaaaactgaacacaatcctgatcatcactcctgcctggctgtctcctgggaggctgccgggtgccacggagctgggacacagcagagcccgctaggtgttgcagggccctggaggccaaggccaccctgtgtggggtccctgttggcagccaggtccctacacaaacaagtaatcctgtttggcctcctaggttttgcatatgacctgcagcctaatttggggtgtaggggaagctctgctggcccctgctcctttgtatgttgggtgactttaatggctggccacatacccctttctcccagctactcattcactgacttgggtaagttctaagacagttcgcacttagaaaagaatgtgacacatcaacattaacttttcctgaaaagaagagtttgcctaacatggtcctaaagaagcttggaatttataagactttcctttataagatatagtgggggtttttttgggtggaggggggttgttttttgttttttgttttcaagacagagtctcgctctgttgtccaggctggagtgtagtggcatgatctcggctcactgcaacctctgcctcccaggttcatgccattctcctgcctcagcctcccgagtagctgggactacaggtgtctgccgccacgcctggctaatttttttgtatttttagtagagacggggtttcaccatgttggtcaggatggtctcgatttcctgacctcgtgatccgcctgtctcggcctcccaaagtgctgggattacaggcgtgagccaccacgcctggcctataagatacggtaaaaaaaaaaaactgtgacccctttgtcactaagggagaaagaaattaagtattgtcaaagttctataaagaatggaaatgtatgatattatacttcaaaggaatttgatgttgaaattttaaagaaaatttgtcatgttgatgagaagcttcactttcctgggaacttcattcgttttagggcatgagataaaagtcctggctaggggagccataggtctgttgtacaaggaatttgctttctaaacaagttgtaacttgccctaaggtccctgttggagcactaagaggtgacacaggccagagacaacgtttcgtttccccttccctgcaagctgggatcagccctgtgttttctcctttcagctgaagtgagcgaaggttctcagtgctggcaaaagagcccactttctaaaaggacttgggaagaaagctgctgggaacttgcttattaaaaagttccttagaattaaggtatctacccactgttttcgcacctttcaccttcctgggctttcctgccctccagcattcttctctagagaggttcctagcccgctcagcgcgagcgtctccagtaggtaatagcagctgaacgtgggttttccacggacttcaggcttggaggtgccatatacaagcacacttcttccttcccctggcttctccatgccaccacccactttaaagatgtaaactcagtagatttttcatccagtgaacggtcatcttcacatcgaaaggtgaaggccaccactgttctcaatgccaagcaacagaacgttctgagatggccgttcttccttgcacagcagctacggcaggttgttctgcagccaccccttagagggggctcttcgttttacctttgtacagttcttgtgtttacacatttgggccaaacagctttcagcaagggcatgtgtccacagctgatgggcagttaagaaccagcctgagctgaaggctagtaataccgtgctgtaggctctttaaaaggaaagcctggcataaacccagcatggaaaggaacattatcagttatctcaaattttgtctgccagggacaagaccctgttcattcttttgcccttttcagaactgtgagcttcaagtattcttgcttctctgtaaagggaagacatctcccttctctgaaatccttcaacaaaagaaaaggctcttggcagggtaggggagtcagtagctcaacactagatcatccctagagatggggcaagtttctgtctgaacacgtcttgggtccgagtccttaggtgttcggatgcagtactttgtgaatacttaagctactgcatgcttggtgtagcttgcaatttctctgtatttaaaagcagctgtgtttattttcttcaaaataacctgtatattatttagagcaagcaatgtaaatattactgagaagttactgcagggatttttgtgacagagtttgtatgggtttttaaaaaaatcttagacacccctttttaagatggggagaacagggttgactgcaccgttgaagcccgcccagcattataaggaaatgtttttaatgactgctgcatctttgtaaaacgtttggtcatctaacagatggttttaaagtgtacaatatccaaaataacgatagccctgtatccatacattgtttcattgaaagaattctctattgcctcttcttggtagagccagagtccttaaggaaaatcaggaaaattaagaaaatgatggtgccatcttgaccagacttctgcacagtaatttaacgctatcctagggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaacgttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcaccctttg

SEQ ID NO: 156819 - DNA, 914 bp, Homo sapiens
  Payload ID: 10740
  Gene Symbol: MPRIP
  Gene Name: myosin phosphatase Rho interacting protein
  ENST ID: ENST00000429184
  CDS Start-End: 1-832
cacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttg

SEQ ID NO: 156820 - DNA, 4043 bp, Homo sapiens
  Payload ID: 10740
  Gene Symbol: MPRIP
  Gene Name: myosin phosphatase Rho interacting protein
  ENST ID: ENST00000414263
  CDS Start-End: 1-3275
tccggttctccacaatccagtgccaaagatacattcaccccgaagggtctgagaagacctggaccagcagcacatcttccgacaccagccaggaccggtcaccctcggaagaaagcatgtcctcagagcctgcacccagtgtactgcctgcaactggcgactctgacacgtacctctccatcatccactccctggagaccaagctctacgtcacagaggaaaagctcaaagacgtgaccgtgaggctggagagccagcagggtcagagccgtgaggcactgctcgcactgcaccaccagtgggcgggcaccgaggcccagctgcgtgagcagctccgcgccagcctgctccaggttggcgcactggcctcccagctggagcaggagaggcaggagagggccaggagggttgaagggcatgttggagagcttggggacttccaggtcaagaatagtcaggccctgatgtgcctggaaaattgccgagaacaactgagatctctgcctagggccagccaggaggatgagcaggacgcacgcgcagcctccctggccagtgtggagagtgcactcgtcagcgccatccaagccctgcagcactggccggccccagcccatggcggggcccgtgcacagctggagacaggtggcaccgaggagaatgggaagcctgcctccctgcagcagtgctcccagtctgagttgacagagcaggagcaggtgaggcttctttctgaccagattgctctggaggcctcgctgatcagccagatagcagattccctgaagaacacaacatcagatgtctcccgaatgctccatgagatttcttggtcaggacagccaccgatggaatctgctggggcccccgtagacacctgggccaggaaggtcctagtggatggtgagttctggagccaggttgagtctctgaggaagcacttggggacactgggaggagaggcagtcggtgcctcaggagacgggcagcaaagcatcccacagggcctggcccccatcctggccaatgccacatgggtcagggcagagctcagctttgccacacagtcagtgagggagtcgttccaccgcaggctacagagcatccaggagaccctgcggggcacccagacggccctgcggcagcacaaatgcctgctgagggaaatcctgggagcctaccaaaccccagactttgaaagagtgatgcagcaggtcttggaagccctcaggcttccagcgggccatgaagatggtgttcagctgtcctgggacctgagccccttaggagaagtcctgggccgagactcagacagctctcaggagcccttcgatgtgtctgaccagagccctggggcctttgttgctattcaggaggagcttgcccagcagctgaaggagaaggccagcctcttagaggagatagcggctgccttaccatctctgccacctgtggaatcgctgagagattgccagaagcttctccaggtgtcccagagtctctcgtataacacttgtttgggaggcctcggtcagtattcttcattgttggttcaggatgccattattcaggcccaggtttgctatgcgtcctgcagaatccggctagaatatgagaaggagctccagctctgcaaggagtcctggcaaacccgggagccctcctgctcagagcaggcacaggcagcccgggccctgagggaggagtatgaggagcttctccgcaagcagaagagcgagtacctggatgtgatcgccattgttgaaagggagaatgcagagctcaaggccaaggccgcccagctagaccatcagcagcagtgtctggaggatgcagagagcaagcacagcatgagcatgttcaccctgcggggcaggtatgaggaggagattcggtgtgtggtggagcagctgaccaggaccgagagcacactgcaggctgagcgcagccgggtcctgagccagctggatgcctcggtcagagacaggcaggacatggagaggcatcatggtgagcagatacagaccctggaggacaggttccagctcaaggtccgggagctgcagacgatccacgaggaggagctgaggaccctgcaggagcactactcgcagagcctgaggtgccttcaggacaccctctgcctccaccaggggccacaccccaaggccctgccagcccctgcccccaactggcaggccacccagggagaggctgactccatgacggggctgagggagcgcatccaggagctggaggcccagatggatgtcatgcgggaggagctgggacacaaggacctggagggcgacgcggccacactgcgtgagaagtaccagagggacttggagagccttaaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgaaatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 156821 - DNA, 513 bp, Homo sapiens
  Payload ID: 10740
  Gene Symbol: MPRIP
  Gene Name: myosin phosphatase Rho interacting protein
  ENST ID: ENST00000577514
  CDS Start-End: 95-513
gaccggagcctgagaggcgggccgcagcgggaagcagcgggcccgaggccgcgcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgg

SEQ ID NO: 156822 - DNA, 3195 bp, Homo sapiens
  Payload ID: 10740
  Gene Symbol: MPRIP
  Gene Name: myosin phosphatase Rho interacting protein
  ENST ID: ENST00000584067
  CDS Start-End: 1-2535
aagaagaaacggaaagtggagccccccacaccacaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcggcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgc

SEQ ID NO: 156823 - DNA, 844 bp, Homo sapiens
  Payload ID: 10740
  Gene Symbol: MPRIP
  Gene Name: myosin phosphatase Rho interacting protein
  ENST ID: ENST00000579361
  CDS Start-End: 1-178
cctaaaggactgctatctggatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaa

SEQ ID NO: 156824 - DNA, 751 bp, Homo sapiens
  Payload ID: 10740
  Gene Symbol: MPRIP
  Gene Name: myosin phosphatase Rho interacting protein
  ENST ID: ENST00000578209
  CDS Start-End: 1-544
ggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtgtacgacacctgttctacctgggaatgcaaaccctgagctgcaaataagaacacagacgtgggagacaccacggcctgaagctgctctcctcttccccgctctcctctcctccggtcccgtgatgggttacgctgagccagcaatgtgcacgcactaactccacaggtgttaaagacactttctgctgaaccatttgaaagcaagctgtagggccctcgacatggcagcacccaggagaataagggcatctccacagctgagaccatgactgcagccaggagtgcctggacggacgcatctgacatccagccgtgtgcacaagcccagggctgctgcctgcttgacggctgctgttctttggatc

SEQ ID NO: 156825 - DNA, 438 bp, Homo sapiens
  Payload ID: 10740
  Gene Symbol: MPRIP
  Gene Name: myosin phosphatase Rho interacting protein
  ENST ID: ENST00000579832
  CDS Start-End: 1-86
ggcggaactggatccagaccatcatgaagcacgtgcacccgaccactgccccggatgtgaccagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctacc

SEQ ID NO: 156826 - DNA, 309 bp, Homo sapiens
  Payload ID: 10740
  Gene Symbol: MPRIP
  Gene Name: myosin phosphatase Rho interacting protein
  ENST ID: ENST00000462033
  CDS Start-End: 1-286
caagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaaggtgagtctggggtccagccccctggtgggaggggcttgagggacactggggagagtagccca

SEQ ID NO: 156827 - DNA, 2796 bp, Homo sapiens
  Payload ID: 10741
  Gene Symbol: MYLIP
  Gene Name: myosin regulatory light chain interacting protein
  ENST ID: ENST00000349606
  CDS Start-End: 505-1299
gcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaaacaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgttttaatgtcatttctgtctttataacttgatcaagaatgattggaaggcaaacaggtttacaaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaa

SEQ ID NO: 156828 - DNA, 1666 bp, Homo sapiens
  Payload ID: 10741
  Gene Symbol: MYLIP
  Gene Name: myosin regulatory light chain interacting protein
  Uniprot ID: Q8WY64
  ENST ID: ENST00000356840
  CDS Start-End: 199-1536
gggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaaacaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaa

SEQ ID NO: 156829 - DNA, 11971 bp, Homo sapiens
  Payload ID: 10742
  Gene Symbol: MYO5A
  Gene Name: myosin VA
  Uniprot ID: Q9Y4I1
  ENST ID: ENST00000356338
  CDS Start-End: 75-5561
agtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacgaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggatat

SEQ ID NO: 156830 - DNA, 12220 bp, Homo sapiens
  Payload ID: 10742
  Gene Symbol: MYO5A
  Gene Name: myosin VA
  ENST ID: ENST00000358212
  CDS Start-End: 245-5812
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacgaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctgggcaacaaaccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggat

SEQ ID NO: 156831 - DNA, 684 bp, Homo sapiens
  Payload ID: 10742
  Gene Symbol: MYO5A
  Gene Name: myosin VA
  ENST ID: ENST00000399228
  CDS Start-End: 1-684
cgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgatt

SEQ ID NO: 156832 - DNA, 1758 bp, Homo sapiens
  Payload ID: 10742
  Gene Symbol: MYO5A
  Gene Name: myosin VA
  ENST ID: ENST00000399229
  CDS Start-End: 1-1758
ggtgcacctgcctaccgtgtcctcatggagcagctgacctctgtgagcgaggagcttgatgtccgcaaggaggaagtcctcatcttaaggtctcaactggtgagccagaaagaggccatccaacccaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 156833 - DNA, 12225 bp, Homo sapiens
  Payload ID: 10742
  Gene Symbol: MYO5A
  Gene Name: myosin VA
  Uniprot ID: Q9Y4I1
  ENST ID: ENST00000399231
  CDS Start-End: 245-5812
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacgaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggatataaa

SEQ ID NO: 156834 - DNA, 12220 bp, Homo sapiens
  Payload ID: 10742
  Gene Symbol: MYO5A
  Gene Name: myosin VA
  ENST ID: ENST00000399233
  CDS Start-End: 245-5812
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacgaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagccctctcagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggat

SEQ ID NO: 156835 - DNA, 5989 bp, Homo sapiens
  Payload ID: 10742
  Gene Symbol: MYO5A
  Gene Name: myosin VA
  ENST ID: ENST00000553916
  CDS Start-End: 36-5597
gcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacgaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcac

SEQ ID NO: 156836 - DNA, 3008 bp, Homo sapiens
  Payload ID: 10742
  Gene Symbol: MYO5A
  Gene Name: myosin VA
  ENST ID: ENST00000556196
  CDS Start-End: 75-218
agtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacgaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagc

SEQ ID NO: 156837 - DNA, 693 bp, Homo sapiens
  Payload ID: 10742
  Gene Symbol: MYO5A
  Gene Name: myosin VA
  ENST ID: ENST00000568914
  CDS Start-End: 1-693
cgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgatt

SEQ ID NO: 156838 - DNA, 12139 bp, Homo sapiens
  Payload ID: 10742
  Gene Symbol: MYO5A
  Gene Name: myosin VA
  ENST ID: ENST00000613858
  CDS Start-End: 245-5731
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacgaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctgggcaacaaaccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaatcttattaaaatatgtgcaatatttatggaagtcaaacagcttcatatcagtgataaagattgttattaaaagataaatactgtctgttaatttacatgggcctcaagttcctcgtttataaaataagagagttggacactgattcttaacatctcctccacatttaaaattctctcttctcagcccttagattctagagagaaaaagctgcagttactcagtaagtccattctctgatggaaagaccagtgtgtagtgcctgtcaattccttaggattaatcaaatgtaaaatcacaagtttgtgtagctgtaacctttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggat

SEQ ID NO: 156839 - DNA, 9505 bp, Homo sapiens
  Payload ID: 10743
  Gene Symbol: MYO5B
  Gene Name: myosin VB
  Uniprot ID: Q9ULV0
  ENST ID: ENST00000285039
  CDS Start-End: 301-5847
tcgccggccctcgcctcctccccacacctgggaggggagtggtgcggcgcggcctcctcccccggcgctcgcaactcctgtccggccgtagctgcgccgccgcggcgggagtaaaggtcgcgccgccgggagcgagccggccgcggcgcctgcgggaagccggcggggcaggtcggagaagagcgagaagatcgagaaactccaggccagcccgggaacatggcgccaggcgggccagccgcggactgagagccgcggggcagccaggagccggggcccgagccccgcccggcccgggccatgtcggtgggcgagctctacagccagtgcacaagggtctggatccctgaccctgatgaggtatggcgctcagctgagttaaccaaggactacaaagaaggagacaagagcctacagctcagactggaggatgaaacgattctggaatacccaattgatgtacaacgcaaccagctgcccttcttacggaatccagatatcttggtgggagaaaatgacctgactgcccttagctatcttcatgagcctgcagttttgcataatttgaaggtccgtttcctggagtccaaccatatctacacttactgtggtatcgtacttgttgccattaatccttatgaacagttgccaatctatggacaagatgtcatctatacctacagtggccaaaacatgggagacatggacccccacatctttgctgtggcagaagaagcctacaagcagatggccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatgggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtaaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccagcaagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctgcatctgctcatggagaccctgaatgccacgacacctcactatgtccgctgcatcaagcccaacgatgagaagctcccctttcactttgacccaaagagagcagtgcagcaactcagagcctgcggggtgttggagacgattcgaatcagtgcagctggctacccatccaggtgggcctaccatgactttttcaaccggtatcgggtgctggtcaagaagagagagctcgccaacacagacaaaaaggccatctgcaggtctgtcctggagaacctcatcaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacagcaagactgaggattggggatatttaaatgaagatggagaactcggcttggcctaccaaggcctaaagcaagttgccaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaacgaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacataatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttgacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttatttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaa

SEQ ID NO: 156840 - DNA, 3109 bp, Homo sapiens
  Payload ID: 10743
  Gene Symbol: MYO5B
  Gene Name: myosin VB
  ENST ID: ENST00000324581
  CDS Start-End: 1-2898
gtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatg

SEQ ID NO: 156841 - DNA, 1693 bp, Homo sapiens
  Payload ID: 10743
  Gene Symbol: MYO5B
  Gene Name: myosin VB
  Uniprot ID: Q9ULV0
  ENST ID: ENST00000592688
  CDS Start-End: 256-1512
tcctgagttccagagcaggtggcaacagcctgtgaagagcagctctcctggcagcgtccctgactggcgcatttctgacggctgcccatgggccgcactggtcacctccaactgcaagcaggattttacccccaccatcccaggccgggctgatgtctgttctcacactgcttcctctgcttccaggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacct

SEQ ID NO: 156842 - DNA, 2726 bp, Homo sapiens
  Payload ID: 10743
  Gene Symbol: MYO5B
  Gene Name: myosin VB
  ENST ID: ENST00000616031
  CDS Start-End: 352-2514
agccctacattctgctgctgctgcagagtgatgatttttaacagaccagaacttacacatctaaatgagtgttgttgttcagtgaagtcaccttaggacaatgatttaaataacaccgcgatttctcaagaagtttggaacttctcttatggttgagttcaaagccattttatgttatatgtggcccaaacaagttttattagtacaattaaatctttattgaggacttttgatggaccacatagtgaacttggactgggaatcaaaagaatggtaaggcagggtgtctgccttcactgtgcctgcagtctggctgagatgcacatgtgagccacactagcacaagccagcatgcactggcctgtcacaagagagtgcacaagggtctggatccctgaccctgatgaggtatggcgctcagctgagttaaccaaggactacaaagaaggagacaagagcctacagctcagactggaggatgaaacgattctggaatacccaattgatgtacaacgcaaccagctgcccttcttacggaatccagatatcttggtgggagaaaatgacctgactgcccttagctatcttcatgagcctgcagttttgcataatttgaaggtccgtttcctggagtccaaccatatctacacttactgtggtatcgtacttgttgccattaatccttatgaacagttgccaatctatggacaagatgtcatctatacctacagtggccaaaacatgggagacatggacccccacatctttgctgtggcagaagaagcctacaagcagatggccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatgggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtaaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccagcaagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatgg

SEQ ID NO: 156843 - DNA, 6971 bp, Homo sapiens
  Payload ID: 10744
  Gene Symbol: MYO5C
  Gene Name: myosin VC
  Uniprot ID: Q9NQX4
  ENST ID: ENST00000261839
  CDS Start-End: 163-5391
aactcgggaacgggaacaggaggccgttggaaaactttgggcaagatggcccggcggtgatttccgcggcggtctctcctgcgcccggcctctgcggcgcaggcccagcccccgagcctcgcacgttcggcagccccggcctggccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccggaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgcgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagttggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattggaatgtgatttaaggaagaaaacagacttttctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaacaacctcagattgaaaaagcaacctaaattactttcgctctctaatcagcatttcaatgtatttatttttaaattttctcaaaaagtaactaaaaaattgtgtcggaccctacttttgagaaatctacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcatttcaatacattgtacatgaaaaaatgaaaagtagaactttgtaatactttaatcaataaaattaattaccaaa

SEQ ID NO: 156844 - DNA, 770 bp, Homo sapiens
  Payload ID: 10744
  Gene Symbol: MYO5C
  Gene Name: myosin VC
  ENST ID: ENST00000558479
  CDS Start-End: 451-770
gttggaaaactttgggcaagatggcccggcggtgatttccgcggcggtctctcctgcgcccggcctctgcggcgcaggcccagcccccgagcctcgcacgttcggcagccccggcctggccccggcccctcctgcccatggcggtggccgagctgtacacgcagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaa

SEQ ID NO: 156845 - DNA, 3074 bp, Homo sapiens
  Payload ID: 10744
  Gene Symbol: MYO5C
  Gene Name: myosin VC
  ENST ID: ENST00000558902
  CDS Start-End: 134-595
gaaaactttgggcaagatggcccggcggtgatttccgcggcggtctctcctgcgcccggcctctgcggcgcaggcccagcccccgagcctcgcacgttcggcagccccggcctggccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagatgggaaatctgaggcacaggacctggacctgctgactctttacctaaatctttactgcataaccccagccgcagctcctgagctccctccgctttatgtcttcgtctgtgagctggactctcagagggcacccattcctggttctgatgcttataatgagggagcaggtggtgcttacatgagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcagttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccggaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaa

SEQ ID NO: 156846 - DNA, 6076 bp, Homo sapiens
  Payload ID: 10744
  Gene Symbol: MYO5C
  Gene Name: myosin VC
  ENST ID: ENST00000560809
  CDS Start-End: 21-830
ggccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaaggagtgccgaagaatttaattatacaagaatgggaggcaatactgtcattgagggtgtgaatgatcgagctgaaatggtagagactcaaaagaccttcacgcttctgggaaatgtgctaatcccctcacggtgactgaatatggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcagttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccggaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgagatgctggaggaacataaggctgtgatcctacagaaatacgcacgggcgtggctggccagacgcagattccagagtatccgacgattcgtgcttaatattcagcttacttacagggtccagcgtttgcagaaaaagttggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaaggcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattggaatgtgatttaaggaagaaaacagacttttctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaacaacctcagattgaaaaagcaacctaaattactttcgctctctaatcagcatttcaatgtatttatttttaaattttctcaaaaagtaactaaaaaattgtgtcggaccctacttttgagaaatctacgtttcccaagttttatgggaactggctattccttgtcccgg

SEQ ID NO: 156847 - DNA, 2129 bp, Homo sapiens
  Payload ID: 10744
  Gene Symbol: MYO5C
  Gene Name: myosin VC
  Uniprot ID: Q9NQX4
  ENST ID: ENST00000559459
  CDS Start-End: 109-1401
cggtgatttccgcggcggtctctcctgcgcccggcctctgcggcgcaggcccagcccccgagcctcgcacgttcggcagccccggcctggccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcagttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtaccgtgaaggtctccatcaatgctgtcaaccccggaacctgtacagcctccagaaggagtaggcaggccaggaatgtttctgatcagattcaagtcatacttaacatgtagctttgatgagtgtgtgtttaacagttccttatttgtttttgtggcgagatacatgagttccaactgtactactttaaagacgaatgtgttgttagaagaccacacttctgattttggatgtactgaagttactgaatttcattaacctcttatcagtttattttctatatgaaattgtgataatcaagacagcataattcttccttatgatgaaagctatatttttttctgaagttctatttgattaaactggactatattacagtggcaacataggttaactcaa

SEQ ID NO: 156848 - DNA, 5387 bp, Homo sapiens
  Payload ID: 10745
  Gene Symbol: MYO6
  Gene Name: myosin VI
  ENST ID: ENST00000369975
  CDS Start-End: 26-3787
ggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttcc

SEQ ID NO: 156849 - DNA, 5597 bp, Homo sapiens
  Payload ID: 10745
  Gene Symbol: MYO6
  Gene Name: myosin VI
  Uniprot ID: Q9UM54
  ENST ID: ENST00000369977
  CDS Start-End: 140-3997
cttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttcc

SEQ ID NO: 156850 - DNA, 8692 bp, Homo sapiens
  Payload ID: 10745
  Gene Symbol: MYO6
  Gene Name: myosin VI
  ENST ID: ENST00000369981
  CDS Start-End: 280-4167
gtgcacgccgcagtgccggggactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggaggtacttggattcctatccggtaacttctaaaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaacaaaatttagtagccaaattgttttttaatgacatgtctctttagtacaatagttttgtgtatcttttagatacattaataggcactagatggaaaattaaagagttaaacatatttaaatgagagaatctaatgtttcagaaatttgtaagaaatgtatcacagcaaagggttgttataagtccttagtttttgactctaatagttaatacaattatagttaatcttaagccataatgtttctaatcatgtcacacagctgtcctagaacttatctatttaaaatagtttcctgagttaattttggccagcagggcaactgccctaattcagatagatttacagtaacctacgtacagtagatgcacatacacacagacacccctttgctggagaaacttaggaccctgtcagccttttaaaggaaacagcaggagtggtgtcctaaatgatgttcatgcagctgctttaccatgttcacagtcaagcccatgcatgccaggttaaaactgtggaaatcaaaagtaaattcactcatattttaatcattttaactgagatttaaaattagaagtttaaaccactatatataaagaactaatcttttcttaataccagttctttccatagcatatgctttgcaaaggcagcatgcataaaatatttaaaatgagaggacagaatgttttcacatttgattcaattttaatataattcctaattgtggtaacacagttgagatatgtattatgagttatgggaactaattgagaaaaggaagttactctaatccacgtatgttaagagaatattgagttttcttagttgtaaagttggggagatggcaccttctcagaggattgtgaaaatatgaggaagaaacaaaacagtgcatgtaggagcacagggccacacaaaggcattctattgttatgctcattctgcttctgtaatgacttttcataggtcattcttgtgaaccattttgttttgcaagcaaccaaggaaagaacatcttaagtggaaaatcagtggtggttgtgaacacttagagaatagcaatccacaggcaagaataatggtattgtttgtagagctttattaattggatattttttaaaagacattttcattcacaggtcattactatggttctcagcgatccaaatatgtagatcattggtttttttttttacctgaagtagcttaagagtacttggatcagtagaataaatatttattgaatcaatcagtcagccaattaatatgatgttagtgatagacctgcctccttttatggaagaggtaacagatccagagaggtcaagtaatttagttgtagactgaaaaatatatcaaagcctttgctgcaatcatatgtaacaaaaagaaccaaaacaaacactttttagtggcacctgtggatttacaaagggttgcctctctgtcattccacaacttcagaaggtgtgacaggttttccctatttatcattaccaataataacaagtattgagagttttaaaatttctcccagaagataaactaacaaggatggaaggggagggcaaaggatatctaaacatgagaataaggacatgttagagggggggaaacagttgtaacaataaggaaagagaagagcaacagtggaagagacaggttgtgtgcccctaaagattctgcacccccagtttggaaacactgatacattttaggacacagagcactcctagatctctacgaaattttagaatgaataatgtgtaatttataggatcagaacgtatggttattaaaacttggatcaagatatgcccggtgtatacattcttagcacataggaatggcactgccatactggagaaggtcagcagtaaataggcattctgtacataagcctcatggaagggtaagatggagagactggcagaagtagcacctactctgctgggagcacttctctgagtacgctttagttcaattcaaatcactgtattctttccccattgctaacctaatatatgaaacaagcttagctgtctcagaagtttttcaagagatgatcaggaaaaattaatgcacattcaaaaggagaatcttcagtacaaatttgtttttttaaaaatagatttagggctgggcgcggtggctcacgcctgtaatcccagcactttgggaggccgaggcgggtggatcacgaggtcaagacttcgagaccagcctggccaacatggtgaaaccctgtctctactaaaaatacaaaacattagccaggcgtggtagtgggtgcctgtaatccctgctacttgggaggctgaggcaggagaatcacttgaacgcgggaggcagaggttgcagggagccgagatggcgccattgcactccatcctgggcaacaagagcgaaattccatctcaaaaaataaaatagatttagggggtacaagtgcagttttgttacatgggtatattgcatagtggtaaaatgtgggcttttagtgtacctaacacccagagaagcatacattgtgcccagtaggtaatttttcatccctaaaccttttctcagcctcccactttctggagtctccaatgtcggttattccactctttatgtccatatctacacattcaatcctaatttgtaccaagtagcatctcacctttaaatcacaggcttattagttgggtgttttctttttacttatgaaaattcatctagtcaaactgtcaattaatttttcctcatttcattaaaagtgtatatctaatgctttctctaaaaattgatgtactggaaatacaaataaataaatgctccctgtgtagaatttc

SEQ ID NO: 156851 - DNA, 8575 bp, Homo sapiens
  Payload ID: 10745
  Gene Symbol: MYO6
  Gene Name: myosin VI
  Uniprot ID: Q9UM54
  ENST ID: ENST00000369985
  CDS Start-End: 263-4051
ggggactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaacaaaatttagtagccaaattgttttttaatgacatgtctctttagtacaatagttttgtgtatcttttagatacattaataggcactagatggaaaattaaagagttaaacatatttaaatgagagaatctaatgtttcagaaatttgtaagaaatgtatcacagcaaagggttgttataagtccttagtttttgactctaatagttaatacaattatagttaatcttaagccataatgtttctaatcatgtcacacagctgtcctagaacttatctatttaaaatagtttcctgagttaattttggccagcagggcaactgccctaattcagatagatttacagtaacctacgtacagtagatgcacatacacacagacacccctttgctggagaaacttaggaccctgtcagccttttaaaggaaacagcaggagtggtgtcctaaatgatgttcatgcagctgctttaccatgttcacagtcaagcccatgcatgccaggttaaaactgtggaaatcaaaagtaaattcactcatattttaatcattttaactgagatttaaaattagaagtttaaaccactatatataaagaactaatcttttcttaataccagttctttccatagcatatgctttgcaaaggcagcatgcataaaatatttaaaatgagaggacagaatgttttcacatttgattcaattttaatataattcctaattgtggtaacacagttgagatatgtattatgagttatgggaactaattgagaaaaggaagttactctaatccacgtatgttaagagaatattgagttttcttagttgtaaagttggggagatggcaccttctcagaggattgtgaaaatatgaggaagaaacaaaacagtgcatgtaggagcacagggccacacaaaggcattctattgttatgctcattctgcttctgtaatgacttttcataggtcattcttgtgaaccattttgttttgcaagcaaccaaggaaagaacatcttaagtggaaaatcagtggtggttgtgaacacttagagaatagcaatccacaggcaagaataatggtattgtttgtagagctttattaattggatattttttaaaagacattttcattcacaggtcattactatggttctcagcgatccaaatatgtagatcattggtttttttttttacctgaagtagcttaagagtacttggatcagtagaataaatatttattgaatcaatcagtcagccaattaatatgatgttagtgatagacctgcctccttttatggaagaggtaacagatccagagaggtcaagtaatttagttgtagactgaaaaatatatcaaagcctttgctgcaatcatatgtaacaaaaagaaccaaaacaaacactttttagtggcacctgtggatttacaaagggttgcctctctgtcattccacaacttcagaaggtgtgacaggttttccctatttatcattaccaataataacaagtattgagagttttaaaatttctcccagaagataaactaacaaggatggaaggggagggcaaaggatatctaaacatgagaataaggacatgttagagggggggaaacagttgtaacaataaggaaagagaagagcaacagtggaagagacaggttgtgtgcccctaaagattctgcacccccagtttggaaacactgatacattttaggacacagagcactcctagatctctacgaaattttagaatgaataatgtgtaatttataggatcagaacgtatggttattaaaacttggatcaagatatgcccggtgtatacattcttagcacataggaatggcactgccatactggagaaggtcagcagtaaataggcattctgtacataagcctcatggaagggtaagatggagagactggcagaagtagcacctactctgctgggagcacttctctgagtacgctttagttcaattcaaatcactgtattctttccccattgctaacctaatatatgaaacaagcttagctgtctcagaagtttttcaagagatgatcaggaaaaattaatgcacattcaaaaggagaatcttcagtacaaatttgtttttttaaaaatagatttagggctgggcgcggtggctcacgcctgtaatcccagcactttgggaggccgaggcgggtggatcacgaggtcaagacttcgagaccagcctggccaacatggtgaaaccctgtctctactaaaaatacaaaacattagccaggcgtggtagtgggtgcctgtaatccctgctacttgggaggctgaggcaggagaatcacttgaacgcgggaggcagaggttgcagggagccgagatggcgccattgcactccatcctgggcaacaagagcgaaattccatctcaaaaaataaaatagatttagggggtacaagtgcagttttgttacatgggtatattgcatagtggtaaaatgtgggcttttagtgtacctaacacccagagaagcatacattgtgcccagtaggtaatttttcatccctaaaccttttctcagcctcccactttctggagtctccaatgtcggttattccactctttatgtccatatctacacattcaatcctaatttgtaccaagtagcatctcacctttaaatcacaggcttattagttgggtgttttctttttacttatgaaaattcatctagtcaaactgtcaattaatttttcctcatttcattaaaagtgtatatctaatgctttctctaaaaattgatgtactggaaatacaaataaataaatgctccctgtgtagaattt

SEQ ID NO: 156852 - DNA, 522 bp, Homo sapiens
  Payload ID: 10745
  Gene Symbol: MYO6
  Gene Name: myosin VI
  ENST ID: ENST00000430435
  CDS Start-End: 1-522
aaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagcttggattcctatccggtaacttctaaaaatgatggaacaagacccaaaatgacaccaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttgg

SEQ ID NO: 156853 - DNA, 4026 bp, Homo sapiens
  Payload ID: 10745
  Gene Symbol: MYO6
  Gene Name: myosin VI
  Uniprot ID: Q9UM54
  ENST ID: ENST00000615563
  CDS Start-End: 33-3821
ggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgc

SEQ ID NO: 156854 - DNA, 4074 bp, Homo sapiens
  Payload ID: 10745
  Gene Symbol: MYO6
  Gene Name: myosin VI
  ENST ID: ENST00000627432
  CDS Start-End: 25-3909
gagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagcttggattcctatccggtaacttctaaaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggt

SEQ ID NO: 156855 - DNA, 7462 bp, Homo sapiens
  Payload ID: 10746
  Gene Symbol: MYO7A
  Gene Name: myosin VIIA
  Uniprot ID: Q13402
  ENST ID: ENST00000409709
  CDS Start-End: 273-6920
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctg

SEQ ID NO: 156856 - DNA, 7106 bp, Homo sapiens
  Payload ID: 10746
  Gene Symbol: MYO7A
  Gene Name: myosin VIIA
  Uniprot ID: Q13402
  ENST ID: ENST00000409619
  CDS Start-End: 348-6848
cacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcaggagaaaagctgggacttgccccacgttacacagccacactgaggcatgtgtcgtgtcacaaacgagatcttccattcaagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttg

SEQ ID NO: 156857 - DNA, 4050 bp, Homo sapiens
  Payload ID: 10746
  Gene Symbol: MYO7A
  Gene Name: myosin VIIA
  ENST ID: ENST00000409893
  CDS Start-End: 267-3803
ggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccggtcagtgccgggaggcggggacaccagggcctgaaagtcttttggtggctgagtggtgcctctgtcaacctagcaagagattaagccaagcaggcctgggtttggcttcgctgctagctagttggtggagttaggaccttggtggagttatttcatctttctaagcctctgattccttgtctgtaaagggggaatcctaaaacaggcatcccttggagatattgcaggttcagttgaaggccacagaaataaatatcacaataaagagagctgcagaaata

SEQ ID NO: 156858 - DNA, 7336 bp, Homo sapiens
  Payload ID: 10746
  Gene Symbol: MYO7A
  Gene Name: myosin VIIA
  Uniprot ID: Q13402
  ENST ID: ENST00000458637
  CDS Start-End: 267-6794
ggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctg

SEQ ID NO: 156859 - DNA, 4616 bp, Homo sapiens
  Payload ID: 10746
  Gene Symbol: MYO7A
  Gene Name: myosin VIIA
  ENST ID: ENST00000458169
  CDS Start-End: 1-4074
ttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctg

SEQ ID NO: 156860 - DNA, 4016 bp, Homo sapiens
  Payload ID: 10746
  Gene Symbol: MYO7A
  Gene Name: myosin VIIA
  ENST ID: ENST00000620575
  CDS Start-End: 267-3863
ggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggtcctgcaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggacaccagggcctgaaagtcttttggtggctgagtggtgcctctgtcaacctagcaagagattaagcaggcctgggtttggcttcgctgctagctagttggtggagttaggaccttggtggagttatttcatctttctaagcctctgattccttgtctgtaaagggggaatcctaaaacaggcatcccttggagatattgcaggttcagttgaaggccacagaaataaatatcacaataaagagagctgc

SEQ ID NO: 156861 - DNA, 5077 bp, Homo sapiens
  Payload ID: 10747
  Gene Symbol: MYRIP
  Gene Name: myosin VIIA and Rab interacting protein
  Uniprot ID: Q8NFW9
  ENST ID: ENST00000302541
  CDS Start-End: 343-2922
ggccaggctggccctggctgcctgcggcgcgggcgcctccctcgcagccgctgctgccgacgccgctgcgctcccgcctcctgtcggttcccgggttcccgctgcggctgcggttctggcagccgagcccccgcggtgctgcagcccagctttagcgcgcagaccgacccgcgccccttcttcgccgccggcagcctctaatccacgcggcgcgttgcggcaggtgccctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatgaaaataaa

SEQ ID NO: 156862 - DNA, 4877 bp, Homo sapiens
  Payload ID: 10747
  Gene Symbol: MYRIP
  Gene Name: myosin VIIA and Rab interacting protein
  Uniprot ID: Q8NFW9
  ENST ID: ENST00000396217
  CDS Start-End: 418-2730
gccgacgccgctgcgctcccgcctcctgtcggttcccgggttcccgctgcggctgcggttctggcagccgagcccccgcggtgctgcagcccagctttagcgcgcagaccgacccgcgccccttcttcgccgccggcagcctctaatccacgcggcgcgttgcggcaggtgccctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatg

SEQ ID NO: 156863 - DNA, 2981 bp, Homo sapiens
  Payload ID: 10747
  Gene Symbol: MYRIP
  Gene Name: myosin VIIA and Rab interacting protein
  Uniprot ID: Q8NFW9
  ENST ID: ENST00000425621
  CDS Start-End: 242-2626
ctgcggctgcggttctggcagccgagcccccgcggtgctgcagcccagctttagcgcgcagaccgacccgcgccccttcttcgccgccggcagcctctaatccacgcggcgcgttgcggcaggtgccctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaaggtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagt

SEQ ID NO: 156864 - DNA, 2678 bp, Homo sapiens
  Payload ID: 10747
  Gene Symbol: MYRIP
  Gene Name: myosin VIIA and Rab interacting protein
  Uniprot ID: Q8NFW9
  ENST ID: ENST00000444716
  CDS Start-End: 99-2678
aacccggcggttccgcagctgtgtttgggagacttgggggcgcattagcctggacagctccctgatcggtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactga

SEQ ID NO: 156865 - DNA, 3144 bp, Homo sapiens
  Payload ID: 10747
  Gene Symbol: MYRIP
  Gene Name: myosin VIIA and Rab interacting protein
  ENST ID: ENST00000458441
  CDS Start-End: 116-463
cctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgc

SEQ ID NO: 156866 - DNA, 3244 bp, Homo sapiens
  Payload ID: 10747
  Gene Symbol: MYRIP
  Gene Name: myosin VIIA and Rab interacting protein
  Uniprot ID: Q8NFW9
  ENST ID: ENST00000458292
  CDS Start-End: 116-2029
cctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgc

SEQ ID NO: 156867 - DNA, 4635 bp, Homo sapiens
  Payload ID: 10747
  Gene Symbol: MYRIP
  Gene Name: myosin VIIA and Rab interacting protein
  Uniprot ID: Q8NFW9
  ENST ID: ENST00000539167
  CDS Start-End: 470-2488
agaaacgagcagtagcactgtgctgttccttcactctggtattgctctctacccagagccctgtgtcttttcttaagaagactacctggcttatcctctgtctgggcttttctggccatgaggacatggagtgaagattttggagctctgtgccctgtgtcctggcgtttaattatttctcaagacacgtgagctaaatttgagtagaagagcttggcagaaagaaaaccaccagttacggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatg

SEQ ID NO: 156868 - DNA, 6694 bp, Homo sapiens
  Payload ID: 10748
  Gene Symbol: MYO7B
  Gene Name: myosin VIIB
  Uniprot ID: Q6PIF6
  ENST ID: ENST00000409816
  CDS Start-End: 33-6383
tccatacaggcttgtggaactgctgactcaggatgtcggggttcaggctgggtgaccacgtgtggctggagcctccctccacccacaagaccggcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctactacagccgccatatgggcgagctgcccccgcatgtctttgccatcgccaacaactgctacttcagcatgaagaggaacaagagggaccagtgctgcatcatcagcggcgagtctggggctggcaagacggagaccaccaagctcatcctgcagttcctggccaccatcagtggccagcattcgtggattgagcagcaggtcctggaagccaaccccatcctggaggcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggctcccgaggagcggaactaccatatcttctactgcatgctcatgggggtgagtgctgaggacaagcagctgctgagcctgggcacgccctccgagtaccactacctgaccatggggaactgcacttcctgtgaggggctcaacgacgccaaggactacgcccacatccgctcggccatgaagatcctccagttctccgactccgagagctgggacgtcatcaagctgctggctgccattctccacctggggaatgtggggttcatggcttcggtcttcgagaacctggacgcctcagacgtgatggagacgcccgcctttcccaccgtgatgaagttactggaggtgcagcaccaggagctccgggactgtctgatcaagcacaccatcctcatccgaggggaatttgtcaccaggtccctgaacattgcccaggctgctgaccggagggacgcctttgtcaagggcatctatgggcacctcttcctgtggattgtcaagaagatcaatgccgccatcttcacaccaccagcccaggaccccaaaaatgtgcggagggccatcggcctcctggacatatttggctttgaaaatttcgagaacaatagcttcgagcagctctgcatcaacttcgccaacgagcacctgcagcagttctttgtgcagcacgtgttcaccatggagcaagaggagtaccgctcggagaacatctcctgggactatatccactacaccgacaatcggcccaccctggacctgctggccctcaagcccatgagcatcatctccctcctggacgaagaaagccgcttcccgcaggggacagatctcaccatgctgcaaaagctgaacagcgtccatgccaacaacaaggccttcctacagcccaagaacatccacgatgccagatttggcattgcccattttgccggcgaggtgtactaccaagcagaaggcttcctggagaagaaccgagacgtgctgagcacagatatcctcaccctggtttactcctccaaaaacaagtttctgagggagatattcaacttggagttagcagagaccaagctgggccatgggaccatccgccaggcaaaggcaggaaaccatctcttcaagtctgcagactcaaataaacggccctccaccttaggaagccagttcaaacagtctctggaccagctgatgaaaatcctgaccaactgccagccttacttcatccgctgcatcaaacctaatgagtacaagaagccgctgctgttcgaccgggagctgtgcctgcggcagctgcgatactcgggcatgatggagaccgtgcacatccgcaagtcgggcttccccatccgctacacgttcgaggagttctcgcagaggttcggcgtgttgctgcccaacgccatgcggatgcagctgcaaggcaagctccgccagatgaccctgggcatcactgacgtgtggctgcggacagacaaagactggaaagcggggaagacaaaaattttcctgagggatcatcaggacactctgctggaggtacagagaagccaggtgctagacagagcggcgctcagcatccagaaagtccttcggggctacagatacaggaaggagttcctgaggcagaggcgggcagctgtgaccctgcaggcctggtggagaggctactgcaacaggaggaatttcaagctgatcctcgtgggctttgagcgcctgcaggctattgcccggagccagccgctggcgaggcagtaccaggccatgcggcagaggacagtccagctgcaggccctgtgcaggggatacctggtgcgccagcaagtccaggccaagaggagggcagtggtggtcattcaggcccatgccaggggcatggctgcccggcgcaacttccagcaaaggaaggccaatgcgccgctggtcatcccggccgaggggcagaaaagccaaggcgctctccctgccaagaagcgcagatccatctacgacaccgtcactgacacggagatggtggagaaggtgttcggcttcctccctgccatgattgggggccaggagggccaggcctcgccgcactttgaggatctggaatcgaagacccagaagctgcttgaggttgacctggacacagtccccatggcggaggagcctgaggaggatgtggatggcctggccgagtacaccttccccaagtttgctgtgacttacttccagaaatcagccagccacacacacatccggcggcccctccgatacccgttgctttaccacgaagatgacactgactgcttggccgccctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacaggtggccagccagctgaacattggagaggaggcattggagcctgatggccttggtgcagaccggcccatgtccaacctggagaaggtgcacttcatcgtgggctacgccatcctgcggcccagcctcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgtcgccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagcaggaga

SEQ ID NO: 156869 - DNA, 3567 bp, Homo sapiens
  Payload ID: 10748
  Gene Symbol: MYO7B
  Gene Name: myosin VIIB
  ENST ID: ENST00000409090
  CDS Start-End: 349-3258
ctgggagcagatgggctgtgcaaagggcgcggctgctgaggacagggctgtggctggagaacctgctgcttcctgaagccgagccccaccctaaaggaccgagagcacaggccatgggagaggaatcgagtagggatgcagagcctggtggcactgtcctgagagaggaggaggctgggcagggccccggcgctggagaggtgccctgcatatgggacctctcagagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgtcgccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagcagga

SEQ ID NO: 156870 - DNA, 822 bp, Homo sapiens
  Payload ID: 10748
  Gene Symbol: MYO7B
  Gene Name: myosin VIIB
  ENST ID: ENST00000437387
  CDS Start-End: 295-822
agagaaatgactgtaatcaccgtgagactggggatcccgcacatctgggagcagatgggctgtgcaaagggcgcggctgctgaggacagggctgtggctggagaacctgctgcttcctgaagccgagccccaccctaaaggaccgagagcacaggccatgggagaggaatcgaggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaag

SEQ ID NO: 156871 - DNA, 6715 bp, Homo sapiens
  Payload ID: 10748
  Gene Symbol: MYO7B
  Gene Name: myosin VIIB
  Uniprot ID: Q6PIF6
  ENST ID: ENST00000428314
  CDS Start-End: 54-6404
gggagtcagccagacccccatcctgacaaggcttgtggaactgctgactcaggatgtcggggttcaggctgggtgaccacgtgtggctggagcctccctccacccacaagaccggcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctactacagccgccatatgggcgagctgcccccgcatgtctttgccatcgccaacaactgctacttcagcatgaagaggaacaagagggaccagtgctgcatcatcagcggcgagtctggggctggcaagacggagaccaccaagctcatcctgcagttcctggccaccatcagtggccagcattcgtggattgagcagcaggtcctggaagccaaccccatcctggaggcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggctcccgaggagcggaactaccatatcttctactgcatgctcatgggggtgagtgctgaggacaagcagctgctgagcctgggcacgccctccgagtaccactacctgaccatggggaactgcacttcctgtgaggggctcaacgacgccaaggactacgcccacatccgctcggccatgaagatcctccagttctccgactccgagagctgggacgtcatcaagctgctggctgccattctccacctggggaatgtggggttcatggcttcggtcttcgagaacctggacgcctcagacgtgatggagacgcccgcctttcccaccgtgatgaagttactggaggtgcagcaccaggagctccgggactgtctgatcaagcacaccatcctcatccgaggggaatttgtcaccaggtccctgaacattgcccaggctgctgaccggagggacgcctttgtcaagggcatctatgggcacctcttcctgtggattgtcaagaagatcaatgccgccatcttcacaccaccagcccaggaccccaaaaatgtgcggagggccatcggcctcctggacatatttggctttgaaaatttcgagaacaatagcttcgagcagctctgcatcaacttcgccaacgagcacctgcagcagttctttgtgcagcacgtgttcaccatggagcaagaggagtaccgctcggagaacatctcctgggactatatccactacaccgacaatcggcccaccctggacctgctggccctcaagcccatgagcatcatctccctcctggacgaagaaagccgcttcccgcaggggacagatctcaccatgctgcaaaagctgaacagcgtccatgccaacaacaaggccttcctacagcccaagaacatccacgatgccagatttggcattgcccattttgccggcgaggtgtactaccaagcagaaggcttcctggagaagaaccgagacgtgctgagcacagatatcctcaccctggtttactcctccaaaaacaagtttctgagggagatattcaacttggagttagcagagaccaagctgggccatgggaccatccgccaggcaaaggcaggaaaccatctcttcaagtctgcagactcaaataaacggccctccaccttaggaagccagttcaaacagtctctggaccagctgatgaaaatcctgaccaactgccagccttacttcatccgctgcatcaaacctaatgagtacaagaagccgctgctgttcgaccgggagctgtgcctgcggcagctgcgatactcgggcatgatggagaccgtgcacatccgcaagtcgggcttccccatccgctacacgttcgaggagttctcgcagaggttcggcgtgttgctgcccaacgccatgcggatgcagctgcaaggcaagctccgccagatgaccctgggcatcactgacgtgtggctgcggacagacaaagactggaaagcggggaagacaaaaattttcctgagggatcatcaggacactctgctggaggtacagagaagccaggtgctagacagagcggcgctcagcatccagaaagtccttcggggctacagatacaggaaggagttcctgaggcagaggcgggcagctgtgaccctgcaggcctggtggagaggctactgcaacaggaggaatttcaagctgatcctcgtgggctttgagcgcctgcaggctattgcccggagccagccgctggcgaggcagtaccaggccatgcggcagaggacagtccagctgcaggccctgtgcaggggatacctggtgcgccagcaagtccaggccaagaggagggcagtggtggtcattcaggcccatgccaggggcatggctgcccggcgcaacttccagcaaaggaaggccaatgcgccgctggtcatcccggccgaggggcagaaaagccaaggcgctctccctgccaagaagcgcagatccatctacgacaccgtcactgacacggagatggtggagaaggtgttcggcttcctccctgccatgattgggggccaggagggccaggcctcgccgcactttgaggatctggaatcgaagacccagaagctgcttgaggttgacctggacacagtccccatggcggaggagcctgaggaggatgtggatggcctggccgagtacaccttccccaagtttgctgtgacttacttccagaaatcagccagccacacacacatccggcggcccctccgatacccgttgctttaccacgaagatgacactgactgcttggccgccctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacaggtggccagccagctgaacattggagaggaggcattggagcctgatggccttggtgcagaccggcccatgtccaacctggagaaggtgcacttcatcgtgggctacgccatcctgcggcccagcctcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgtcgccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagcaggaga

SEQ ID NO: 156872 - DNA, 270 bp, Homo sapiens
  Payload ID: 10748
  Gene Symbol: MYO7B
  Gene Name: myosin VIIB
  ENST ID: ENST00000563538
  CDS Start-End: 1-270
cctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacagagatctggctgcaaggacaaggggaccaaggatatctcctccatgaagctgaagcggtcctcccggatcacaggccaggtggccagccagctgaacattggagagga

SEQ ID NO: 156873 - DNA, 11456 bp, Homo sapiens
  Payload ID: 10749
  Gene Symbol: MYO10
  Gene Name: myosin X
  ENST ID: ENST00000274203
  CDS Start-End: 469-6678
gagagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggcaagagggagctgaattggattctctttcttttcaaagggtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaacacgctgtgtgtttcctttatcagaggaggctctaaaaaccatggaggggaggcttatttttgttttggctttttggtggttttttttttttttctttagagacagagtctcactctgttacccaggctggagtacagtggcgtgatctcggctcactgcagcctctgcctcctgggttctagcgattctcctgcctcagcctcccaaggagttgggagtacaggcatgcatcaccacgcctggctaggttttgtatttttagtagagatggggtttcaccatgttggccaggctggtctcgatccacctgcctcagcctcccaaagtgctgggattacaggtgtgagctaccgcacccggccggctttttggtgttaatgctatggtttcagtgtctgggctttgtgtttgtttcatggacttgctcatcaggtctaaacacagatctgcagctgtctccactgctcttgtagacactgagtgtgacttcaagaaagcaaaagaagggactggtaaatgaagtcacacacagctgaggacttgaaatgtgtttatgtcagacagtcccctatgtcagccccaaagtgtgcctgatcttgcaaccctggatcctagaacctgcctgcacctccctgtggaccagaacacacaggtaggcagtttggttgccaatgtacccaaaccaccaggccaggcgtctagcatgagcaagcgccacttctcttgcagaccactgactcccaccctctgctcatgctcacggatggcttcttcccattctgcagggattgggatggaacctgaagccaggtgctgcctgaagcctgtggccccgccaggcacccaaggaaagccggcaaagacttggatgtgtgttgtctttgtttttattttaggctcagaaagaatttgacagaagtcttctttctactgctcacctctcaggattccctctgtgacttaatttactctggaaggctgtcgcccgccctcaattatagatggggaaataggcaaggaaaggcatgactcagattgggggggttagagcagcaccatagttagaacatagatttacatgtgagcctttacatggcatagttgtggttttgttttagccttttatttagaaataattacagactcagagaaagttgcaacagaacgtacagggaggcctgcgtgcccttcagtttccccagtggtagcatcccccatcactgtagagcagcatcacagctgacaaagtaccgttgagcttcccctagccacagaacctattccaattttactgcttttacatgcactcattggtgtgtgtgatgtcagttgctttcaacaaggtcagtgaagtgcagtcgtcccttggtatccaagggagattggttccaggaccccctccccccacccctgaggatacaaaattcacagatgctcaagtccctgctatacagtggtataatatttgcatagaacctgcacacatctttccttaccctttaaatcatctccaggttacagatacctagcacaacataaatgctgcataaatagctgttataccgtgtgtgtctgtgttttaaacattgtttatttgagacagggtctcactctgtcaccaggctacagtgcagaggcacagtcacagctcattgcagcctcaacctcctgggctcaagcagtcctccacctcagcctcccaaagtgctaggatgacaggtgtgagccactgtgccccaccaaaaaaagttttttcaaatattttctatctgtggttggattcagaccacatgaacactgagggctgactgtagttttgaatgtctgttactgaggaggcaccagcataaagtattttatcacttcagacgctgacaatctagtatttttaatttttaaatcttttgaaagctaatacatataggtgatttgtaaaaaaaaaaaaaaaaaaaaaaaaaaaaaaaaaaaaaaacaactagaagtaaaatgttacttttttccagctgtagccctaattacccattttcctttcccagaaacagctatttttactgttttattgaatattctctcaaaaataatttaagctgtccaatcatttactcatacatacatatatatccccatcctcatttttaatagatggaaacaaactgttgtagcttacttttttctcagcatagtattttagctctaatcctacattaatacctatagaattgccttattctttttgatgattatatagtacctcagatagctctgtggaaaaacaggataaggccatctgtattagtccattctcacactgctagaaggacatgcctgagactgggtaatttataaagaaaaagaagttgaatggactcagtctcacatgcctggggaggcctcacaatcatggtggacagcaaaggaggagaaaaggcacatcttatatggcagcaggcaagagagcttgcacaggggaactcccttttataaaaccattagctcttccgagacatactcactatggacaagaacagcatgggaaaacccacccccatgattcaattacctcccatcaggtccctcccgtgacaggtggggattatgggagctataattcaagatgagatttgggtggggacagagccaaaccatatcaccacctaagttctctgtaaaaatagtttcagccaggcatgctggctcacgcctgtaatcccagcatgttggaaggccgaggcaagaggatcgcttgagctccggagttcaagaccagtctgggcaacatgacaagaccctgtctccacagaaaattaacattagccaggtgtggtggtgcgcatctgtagtcccagctactggggaggctgagatgagaaaatcgtttgaacccaggaggtcaaagctgcagggagccatgatggtgccactgcattctggtgtgggtgacagagcaagactctgtctccaaaaaaaaaaaaaaaaaaaaaaaatagttcagaaatctaagacagcactttttttagttactaagccttttattcagatagcacactaaattggggtcaaaaatctgctatagtaaagttctgtatttgtgtgtattgggtataaaaataagcgctttaattaatttgaaaatccctattcaccaaaagtttatactgtaataggggacaaaacaagtgcataaagctaaatttagccagtacatttataactgtttcattcagttgatcagagaagcatcacgattgctggaaaatatcggacctggattcaaggtttggcattgctgttttcaaagtatgtaatcttttagatcaggggtcagtgaactacagtacagagaccaaatctaccctgccacctgtttttgtgaataaagttttattg

SEQ ID NO: 156874 - DNA, 4803 bp, Homo sapiens
  Payload ID: 10749
  Gene Symbol: MYO10
  Gene Name: myosin X
  ENST ID: ENST00000505695
  CDS Start-End: 480-4673
agcaaagagtgctgttcttgttctctgggtggattttccaagatcacaactaaactgcttgattttgtcctgggactttttttaaaaaaaaattattgattggcttttaaaatcaagaatctttgggccctgaaatgtaattacacatttgttgatgcgtgcatgatggttagtttgcccctgcagtcaaaagtgtcttcagcagttcctatcacgtcagcctcgccaggctggacttcctttgagtagaatcaggaatgaattaagcagcacagcccgagacgcaccacataaaaggctgggaacaccagccagccgaagaaagcccatttttgtgtctgtcagcttagatgcccttgcccggactgctaaagatgcagctatttacagtggacagaaactgaaggggtgaaagaaaacccaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctga

SEQ ID NO: 156875 - DNA, 8038 bp, Homo sapiens
  Payload ID: 10749
  Gene Symbol: MYO10
  Gene Name: myosin X
  Uniprot ID: Q9HD67
  ENST ID: ENST00000513610
  CDS Start-End: 456-6632
gccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaacacgctgtgtgtttcc

SEQ ID NO: 156876 - DNA, 2910 bp, Homo sapiens
  Payload ID: 10749
  Gene Symbol: MYO10
  Gene Name: myosin X
  ENST ID: ENST00000513882
  CDS Start-End: 420-2910
aatctgtgatttaggagtgagttctttccatgcttctcctctcctcttttcccttcctagcaagaggagaaaaaaagcaagtaatttaatgtaatctgatttttttttttttttttttttttacttcatggctttttgacattggaagagaaatgagccatctttctagaggagctttagtgtcatgtgtgcttttcttattgattgggaataacttaaaaagactcctcagaactccgaatgggatatttaatttgttagaacacgagtctgcaccactatctgttgacggtgaaatgaatttactaagtggataatttgctgagcattagctgaccctgacgtggcggaacgaaggtctctggagatggttcatggtggaaatctgggcttgatgggtcggtaatgagacttcagcgatgacatctttaccaaggctgaggcttaacactcgggaccaagcgattcaactgggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaag

SEQ ID NO: 156877 - DNA, 4839 bp, Homo sapiens
  Payload ID: 10749
  Gene Symbol: MYO10
  Gene Name: myosin X
  ENST ID: ENST00000515803
  CDS Start-End: 334-4527
ttctttctaatgccaggcaatcaaggctgcacttgctacccttctgcaggaagcttcccagccagcacagtttctctctgccctgcctcttaatccccacccctgctcccaggcctgggacactgctaaccacccctccttcctgacacctctctgaccacccctcctcctcttgactggttcctctggaggtaggcatggcctcgggttctgcccccagtttctcactcgctgggctccaaaagaaacactggcttctctccttcagctccaggctagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaacc

SEQ ID NO: 156878 - DNA, 1677 bp, Homo sapiens
  Payload ID: 10749
  Gene Symbol: MYO10
  Gene Name: myosin X
  Uniprot ID: Q9HD67
  ENST ID: ENST00000507288
  CDS Start-End: 452-745
cggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatgtgcagataggttgaatatacctaatccaaaaactccaaatccacaatgcttcaaaatccaagacattttgcatgctgatgtgttgctgaaaggaaatgctcattgggaatattttggattttgaatttaacttaaattatgcttaaccagtacatagtatgcaaatattccaaaatccaaaaaatattgaaatccacaacactttgtgtcccaggcatttcacacaagggatgctcaatctatattttgaaactcatactttgctgtcattagagaaaaaacacaagtttgtttttttttgtaatagtgtcttgctatgttgcccaggctagactcaaactcctgagctaaagtgatcctcctgccttagcctcctgagtacctgggattacaggcacgtgccagcatgcccacctagacacaagttgttattgtacattttcaatagtcaagaaaaagtaagtaaattagaaggaaaaaaaaactacacaagggtttaaaaggcagacccttttaaaaagttttttatttattttcctcttttcatgataataatgttaaacctgacagctaaattgccaatacatactatgaataagatcttggtcttggaataaggtcatattcttcctttctaaggggaaacccgtaggatttttgtgcatccaatttgcagttcagttcagttaattatgccattgtagaccttccgtttgaggcttgcaaaattgtatattatccataaagcagccaccatgattttttaaaattatcattgaagccattcaccggagatgtcagcgtctgttggactccgctcacatcgagacaagaccgccacctgtcagaacagccactgcttctccacatttgatcctggctcggagcaatgcctgtctatatctttaaaagagaaaaaaaataaaatgacttgaattgttccaga

SEQ ID NO: 156879 - DNA, 766 bp, Homo sapiens
  Payload ID: 10749
  Gene Symbol: MYO10
  Gene Name: myosin X
  ENST ID: ENST00000502436
  CDS Start-End: 131-766
gcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttatta

SEQ ID NO: 156880 - DNA, 1640 bp, Homo sapiens
  Payload ID: 10750
  Gene Symbol: MYO19
  Gene Name: myosin XIX
  Uniprot ID: Q96H55
  ENST ID: ENST00000621344
  CDS Start-End: 404-1357
ctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccttctgtgctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcaca

SEQ ID NO: 156881 - DNA, 3271 bp, Homo sapiens
  Payload ID: 10750
  Gene Symbol: MYO19
  Gene Name: myosin XIX
  Uniprot ID: Q96H55
  ENST ID: ENST00000613929
  CDS Start-End: 463-2775
cgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgta

SEQ ID NO: 156882 - DNA, 963 bp, Homo sapiens
  Payload ID: 10750
  Gene Symbol: MYO19
  Gene Name: myosin XIX
  ENST ID: ENST00000616159
  CDS Start-End: 434-963
agtctggccgggcgggggcctgaagcacggcggctcgggccgtgggaccggtgagtgtcaacccgaacctatatctgaagcccttcagacgcggaaggggcttgggaggccagtttgccccgcagcggtgaggaagaatgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccc

SEQ ID NO: 156883 - DNA, 3271 bp, Homo sapiens; identical to SEQ ID NO: 156881
  Payload ID: 10750
  Gene Symbol: MYO19
  Gene Name: myosin XIX
  Uniprot ID: Q96H55
  ENST ID: ENST00000610930
  CDS Start-End: 463-2775

SEQ ID NO: 156884 - DNA, 580 bp, Homo sapiens
  Payload ID: 10750
  Gene Symbol: MYO19
  Gene Name: myosin XIX
  ENST ID: ENST00000612097
  CDS Start-End: 1-47
acacccctacccagaacaacatctttaagagcagcaggaggggatagataggatggcctggcagtcgagaaagggaggccacttcagggaggtagcaatgcagtggaaagtgaccctcacctccagatgggggctgctcagacactgccaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcat

SEQ ID NO: 156885 - DNA, 4054 bp, Homo sapiens
  Payload ID: 10750
  Gene Symbol: MYO19
  Gene Name: myosin XIX
  Uniprot ID: Q96H55
  ENST ID: ENST00000614623
  CDS Start-End: 524-3436
gtgctcgccccgcccctagggaggagccggccgacccccggccacttagcagtgccgcagccgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaacaatca

SEQ ID NO: 156886 - DNA, 1186 bp, Homo sapiens
  Payload ID: 10750
  Gene Symbol: MYO19
  Gene Name: myosin XIX
  ENST ID: ENST00000620640
  CDS Start-End: 432-983
ctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccttctgtgctacctccaaggaatcagtcacctctgttctgctgagtctggagaccaggtggtggggtggacggggcataaggaagagtgatgcatacacagtgctagagtacagaatgcagtaagtgatccatgggggcagagagcaa

SEQ ID NO: 156887 - DNA, 559 bp, Homo sapiens
  Payload ID: 10750
  Gene Symbol: MYO19
  Gene Name: myosin XIX
  ENST ID: ENST00000615902
  CDS Start-End: 1-328
gattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggtagcaaggcctcactgtgctgggagcactccagaaaaagagcaataaagccctggatggagaggcaggagccctgggtccactgtgtgactctgggcagttcctttcccttttttgtctcctcttgcatctgcctgccagcatagagcgagatctctgcatagggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatc

SEQ ID NO: 156888 - DNA, 556 bp, Homo sapiens
  Payload ID: 10750
  Gene Symbol: MYO19
  Gene Name: myosin XIX
  ENST ID: ENST00000613551
  CDS Start-End: 423-556
agtctggccgggcgggggcctgaagcacggcggctcgggccgtgggaccggtgagtgtcaacccgaacctatatctgaagcccttcagacgcggaaggggcttgggaggccagtttgccccgcagcgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcc

SEQ ID NO: 156889 - DNA, 5743 bp, Homo sapiens
  Payload ID: 10750
  Gene Symbol: MYO19
  Gene Name: myosin XIX
  Uniprot ID: Q96H55
  ENST ID: ENST00000610992
  CDS Start-End: 951-2861
ggcgctcgtgccagtgtcccgtgggctacccactcctgtcatgtcctttgggctggtgcaggccagatcttctagggccgtagccctgagaggagcgcctggagaggaaacggcgcgccatgcacctcacacggcccctcagacctcacggcgaggccctatcagggtaatggtgtccgccggcctcgcacaacactccgccgcactcgcacaagactccgccgcggcgacctctactgaaagacccccagtcctggtgtcgcccgaaggcccaggaaaccgtgcttccgcgcttctcccccagaacgtgggaagctgccgctttaccctcattttaccccagggtcgcaaaacatctcaccgtagttgaagccagcaagccggaccaggcgtcccggccaagccacgtgcgcgccccgcgccgcgagtgctcgccccgcccctagggaggagccggccgacccccggccacttagcagtgccgcagccgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggcctgacatgagagaggacccatctcccttgctgtggcagggcaggcatgtatggttgtgtggtctgtgcatagtagcctagccagggaggcaagttccagtgcatcttgtttttttgagccatgtaccctgatgagagactgaaactgcccagaggaatgggtgtctcgtgattagctgaaagtctacatcaccacacagtccccgcacagtgcagccatttctcactggaggtatcatttttttcttttttttttttttttttgagactgagcctcactctgtcacccaggctggagtgcagtggtgcaatctcagctcactgcaacttccgcctcccgagttcaagtgattctcctgcctcagtctcccaaatagctggaattacaggtatgcaccaccacacctggctaatttttgtatttttagtagagatggagtttcaccatgttagccaggctggtctcaaactcctgacctcaggtgatctgcccacctcagcctcccaaagtgctgggattacaggcatgagcagccactgcactcagccggtatcatttttttctaatctaacaaaagcactctagccagcagctgcccttttcttgggattccaggttctgagggatgtggatgaggggtgaatgctgggcactgctgaaggtgtggcctggtagatgtggccttccggtttgtagccaggacaactcagctctgtggtaaagacctgggttcaggtcacagaagaatcttcatagtataatcttccctgcctctcagctgtgaaccaccctctaatgcctgcagacagtgaaaacaatccaaactggaaatttgcctgggctgggttgtgtggtagtgagactacactgagggcagggtgagacggagccaggacatcacttgcttcagctgtatcagaagccatgcgtcggatgagggggacttgggaccaccaggaccctttctagtgggagatttgttttcaaggtccctcgatttctcacagccccaaggagatacccccattagccaagccttgggagagcctgcagcttggcactggccagggtctaagaagaagggctgagagaatggcatttctggcctgctggccccatgctgcaggtgcctgccctgtctccccacccttgcaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgcccttctggcccctggttgattttgctgctgtttctcatctgtggtgtctcctttggcagcctctgtcttcagagaggcactgggcatctaaggtggtcagagccctcagaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaaac

SEQ ID NO: 156890 - DNA, 4054 bp, Homo sapiens; identical to SEQ ID NO: 156885
  Payload ID: 10750
  Gene Symbol: MYO19
  Gene Name: myosin XIX
  Uniprot ID: Q96H55
  ENST ID: ENST00000618519
  CDS Start-End: 524-3436

SEQ ID NO: 156891 - DNA, 4299 bp, Homo sapiens
  Payload ID: 10750
  Gene Symbol: MYO19
  Gene Name: myosin XIX
  ENST ID: ENST00000621550
  CDS Start-End: 993-1553
gcacttccgggccggccgattccgcgcgtctccgcccatcatggcgctcgtgccagtgtcccgtgggctacccactcctgtcatgtcctttgggctggtgcaggccagatcttctagggccgtagccctgagaggagcgcctggagaggaaacggcgcgccatgcacctcacacggcccctcagacctcacggcgaggccctatcagggtaatggtgtccgccggcctcgcacaacactccgccgcactcgcacaagactccgccgcggcgacctctactgaaagacccccagtcctggtgtcgcccgaaggcccaggaaaccgtgcttccgcgcttctcccccagaacgtgggaagctgccgctttaccctcattttaccccagggtcgcaaaacatctcaccgtagttgaagccagcaagccggaccaggcgtcccggccaagccacgtgcgcgccccgcgccgcgagtgctcgccccgcccctagggaggagccggccgacccccggccacttagcagtgccgcagccgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccttctgtgctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcacacttctctgctcacttagttttttaaacagtcctctgtgtgtgtttatttccctttatgcctgagaaaaccagagaggtaaagtgacgtgcccaaggtcagataccactaagtggtgatacagagtaccagacatagtaattccaagttcctaccctctctgtcttcccccaacccgtgccccgtcgtcctctggaacatgagactgccccagagcagcaggaggggatagataggatggcctggcagtcgagaaagggaggccacttcagggaggtagcaatgcagtggaaagtgaccctcacctccagatgggggctgctcagacactgccaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgaccaagtttaactccatatgaagtgtaagcttgatatcgtttatgatgtctatcaactgtaccaaaagtaaaacatttaaaa

SEQ ID NO: 156892 - DNA, 786 bp, Homo sapiens
  Payload ID: 10750
  Gene Symbol: MYO19
  Gene Name: myosin XIX
  ENST ID: ENST00000616207
  CDS Start-End: 590-786
tgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacagattggcttaggcccagcctcacaacaccccacctcccagatggattcatctccctgaaatcctcaccttcttgaagttgacactggaccgttcacctgattagcgctcccaaatggatcatcaacccttagtcgtagtgctaacagtgtttatcctctgagtgaatactcagattcgtactttgtgtggtgctgtcaaaccatgacctcattgaccttcacaaccactccttatgaggcagatttaactgtccccattttcaaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacac

SEQ ID NO: 156893 - DNA, 897 bp, Homo sapiens
  Payload ID: 10750
  Gene Symbol: MYO19
  Gene Name: myosin XIX
  ENST ID: ENST00000622055
  CDS Start-End: 411-897
actgtcctccatgcctagaaagaaacagtctgagaaggagggactggtgatcaggttgccacttgccttgattcggtgttccatttactcattaccgtctcctttctgcccacagtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccaca

SEQ ID NO: 156894 - DNA, 5743 bp, Homo sapiens; identical to SEQ ID NO: 156889
  Payload ID: 10750
  Gene Symbol: MYO19
  Gene Name: myosin XIX
  Uniprot ID: Q96H55
  ENST ID: ENST00000633264
  CDS Start-End: 951-2861

SEQ ID NO: 156895 - DNA, 556 bp, Homo sapiens; identical to SEQ ID NO: 156888
  Payload ID: 10750
  Gene Symbol: MYO19
  Gene Name: myosin XIX
  ENST ID: ENST00000633266
  CDS Start-End: 423-556

SEQ ID NO: 156896 - DNA, 897 bp, Homo sapiens; identical to SEQ ID NO: 156893
  Payload ID: 10750
  Gene Symbol: MYO19
  Gene Name: myosin XIX
  ENST ID: ENST00000632090
  CDS Start-End: 411-897

SEQ ID NO: 156897 - DNA, 786 bp, Homo sapiens; identical to SEQ ID NO: 156892
  Payload ID: 10750
  Gene Symbol: MYO19
  Gene Name: myosin XIX
  ENST ID: ENST00000633990
  CDS Start-End: 590-786

SEQ ID NO: 156898 - DNA, 580 bp, Homo sapiens; identical to SEQ ID NO: 156884
  Payload ID: 10750
  Gene Symbol: MYO19
  Gene Name: myosin XIX
  ENST ID: ENST00000633104
  CDS Start-End: 1-47

SEQ ID NO: 156899 - DNA, 1640 bp, Homo sapiens; identical to SEQ ID NO: 156880
  Payload ID: 10750
  Gene Symbol: MYO19
  Gene Name: myosin XIX
  Uniprot ID: Q96H55
  ENST ID: ENST00000633938
  CDS Start-End: 404-1357

SEQ ID NO: 156900 - DNA, 963 bp, Homo sapiens; identical to SEQ ID NO: 156882
  Payload ID: 10750
  Gene Symbol: MYO19
  Gene Name: myosin XIX
  ENST ID: ENST00000633669
  CDS Start-End: 434-963

SEQ ID NO: 156901 - DNA, 559 bp, Homo sapiens; identical to SEQ ID NO: 156887
  Payload ID: 10750
  Gene Symbol: MYO19
  Gene Name: myosin XIX
  ENST ID: ENST00000632349
  CDS Start-End: 1-328

SEQ ID NO: 156902 - DNA, 1186 bp, Homo sapiens; identical to SEQ ID NO: 156886
  Payload ID: 10750
  Gene Symbol: MYO19
  Gene Name: myosin XIX
  ENST ID: ENST00000631623
  CDS Start-End: 432-983

SEQ ID NO: 156903 - DNA, 4299 bp, Homo sapiens; identical to SEQ ID NO: 156891
  Payload ID: 10750
  Gene Symbol: MYO19
  Gene Name: myosin XIX
  ENST ID: ENST00000631888
  CDS Start-End: 993-1553

SEQ ID NO: 156904 - DNA, 11863 bp, Homo sapiens
  Payload ID: 10751
  Gene Symbol: MYO15A
  Gene Name: myosin XVA
  Uniprot ID: Q9UKN7
  ENST ID: ENST00000205890
  CDS Start-End: 339-10931
gggctgggcctcccttccccataacactgagctgctctgctgggccaaccgtgctcctgggccagccagaggacccccatgaggcggcatgcaggcggggagcaggccacagaacgcagggtgaaacccaaggcgctctagaggagatgaattatggatccgccctcccggaatcctggctcggccctccccacgccacccagggccagtcgggtctgctcacagcccgaggaggccgcgtgtccagccgcgggcaagagacagagcaggtccctgtgtctccaagtccctgagcccgtgacaccggccccaggccctgtagagagcaggcagccaccatggcgaaggaggaagatgaggagaagaaagccaagaaagggaagaaggggaagaaggcaccggagccggagaagcccaaacggagcctgaaggggacgtcgcggctgttcatgggcttccgcgaccgtacacccaagatctccaagaagggccagttccgcagcgcctcggccttcttctggggcctccacaccggcccccagaagaccaagcgcaagaggaaggcccgcaccgtgctcaagtccacgtcaaagctcatgacgcagatgcgcatgggcaagaagaagcgggcgatgaagggcaagaagccgtccttcatggtgatccgcttcccaggccgccgtggctacggccgcctgcggccgcgcgcccggtcactcagcaaagcgtccacggccatcaactggctcacaaaaaagttcctcctcaagaaggccgaggagtcgggcagcgaacaggccacagtggacgcctggctgcagcgctcgagctcccgcatgggctcccgcaaactccccttcccgtcgggtgccgagatcctgcggcctgggggccggctccggaggttcccccgcagccgcagcatctacgcgtcaggcgagcccctgggcttcctgcccttcgaggacgaggccccattccatcactcgggctcccgcaagtcgctgtacgggcttgagggcttccaggacctgggcgagtattatgactatcaccgcgacggcgacgactactacgaccggcagtcactccaccgctacgaggagcaggaaccctacctggcgggcctcggcccctacagcccggcctggccaccctacggcgaccactactacgggtacccgcccgaggatccctacgactactaccaccccgactattacggtggcccctttgatccggggtacacctacggctacggctacgacgattacgaacccccatatgcgcccccgtcggggtactcgtctccttacagctaccacgatgggtacgagggcgaggcgcacccttatggctactacctggatccctatgcgccgtacgacgcgccatacccaccctatgacctcccataccacactccctacgatgtaccctactttgatccctacggagtccactacaccgtcccctatgccgaaggcgtctatggcggtggggacgaggccatctacccccccgaggtgccctatttttacccggaggagtcggcttcggcctttgtgtacccctgggtaccaccgcccatcccgtcgccccacaacccgtatgcccacgccatggatgacatcgccgagctggaggaaccagaggacgcgggcgtagagcgtcaggggacctccttccgcctgcccagcgccgccttcttcgagcagcaaggcatggataagcccgccaggtccaagctgtccctcatccgcaagttccgcctcttcccgcgaccccaggtgaagctgtttgggaaggagaagctggaggtgcccctgccaccctctctggacattcctctccccttgggggatgcggacgaagaagaggacgaggaggagctgcccccggtttccgctgtgccctacggccaccctttctggggcttcctcacgccgcgccagcgcaacctccagcgcgcgctgtcggccttcggcgcccaccggggcctgggcttcggccctgagtttggccgccccgtgcctcgccctgccacctcgcttgcgcggttcctcaagaagacgctgtcggagaagaagcccatcgcgcggctcaggggcagccagaaggcccgggcgggcggccctgctgtcagggaggcggcctacaaacgcttcggctacaagctggctggcatggaccccgagaagcccggcacgcccatcgtgctgaggagggcccagccacgcgctcgcagcagcaacgacgcgcgccgcccgcccgcgccacagcccgcgcccaggaccctctcccactggagcgcgctcctgtctccgcccgtgcccccgcggcccccaagctccgggcccccgcccgcgccgccgctctccccggcgctctcgggcctgccccggccggcctcgccctacggctccctccgccgccacccgccgccctgggccgccccagcgcacgtgccaccggcgccgcaggccagctggtgggccttcgtggagccccctgccgtgagcccggaggtgccccccgacctactagccttcccagggccccgaccctcgttcaggggctcccgccggagaggggcggctttcggcttccccggggcctctccacgggcgtcgcggaggcgagcttggtcaccgctggcctcgccccagccctcgctgaggagctcgccgggcctcggctactgctcacccttggcgcccccgtcgcctcagctgtccttgcgcacgggccccttccagccgcccttcctgcccccggcccgccggccccgctcgctgcaggagtccccagccccacgccgagccgctgggcgcctgggcccacccggctcgccgctgccgggctcacccaggccgccctcgccgcccctggggctctgccacagcccgcggcgcagctccctgaatctgccctcgcgcctcccgcacacgtggcggcgcctcagcgagccacccactcgggctgtgaagccgcaagtgcgcctgcccttccaccgaccgcccagggccggggcctggcgggcgcccctggaacaccgggagagcccgcgagaacccgaggactcagagacgccctggactgtgcccccactggcccccagctgggacgtggacatgcctcccacccaacgcccaccctccccctggccaggaggtgcaggcagccgccgaggcttttccaggccaccccctgtgccggaaaacccctttctccagctcctgggccctgtgccatcccccaccctccagcctgaggatccagctgctgatatgaccagggtcttcctgggcagacaccatgagccggggcctggacagctcaccaaatcagctggcccaacccctgagaagcctgaagaagaggccaccctgggggacccccagctgccagcagagaccaagcctccaaccccagcacctcccaaggatgtcactccccccaaggatatcactccccccaaggatgtcctcccagagcaaaagacattaaggcccagcctctcatacccactggctgcgtgtgaccagaccagggccacatggccaccatggcaccgctggggaacactgccccaagccgcagcccccttggcgcccatcagggccccagagcccctgcccaaggggggtgaacggcgccaggcagcccctgggcgttttgctgtggtcatgcctcgtgtgcagaagctgagctctttccagcgagttgggcctgcaaccctgaagcctcaagtccagcccattcaggaccccaagccaagagcctgtagtcttcgctggtcctgcctctggcttcgggcagatgcctatggaccctggccacgagtacacacccatccccagtcctgccacctgggccctggagctgcctgcctgtcccttaggggctcctgggaggaggtcggcccgccaagctggcggaacaagatgcactccatccgcaacctgccatccatgcggttccgtgagcagcacggggaggatggtgtggaggacatgacacagctggaagacctccaggaaaccactgtgctgtccaacctcaagattagatttgaacggaacctcatctacacatacattgggagcatcctggtgtcggtgaacccataccaaatgtttggaatctatgggccggagcaggtgcagcagtacaacggacgggccctgggagagaatcccccgcacctctttgctgttgcaaatctcgccttcgccaaaatgctcgatgccaaacagaaccagtgcataatcattagtggagagagcggctctggcaaaactgaggccaccaagctgattctgcgctacctggccgccatgaaccagaaacgggaggtcatgcagcagataaagatcctggaggcaacacccctcttggagtccttcggtaatgccaaaaccgtcaggaacgacaactccagccgctttgggaagtttgtggaaatctttctggaagggggcgtgatctctggtgccataacctcccagtacctgcttgagaaatccaggatcgtgtttcaggccaaaaacgagaggaattaccacatcttctacgagttgctggccgggttgcctgcccagctcaggcaggcctttagcctgcaagaggctgagacctactactatctgaaccagggtgggaactgtgagatagcaggaaagagcgatgcagatgactttcgccggctcctggctgccatggaggtgttgggcttcagcagtgaggaccaggacagcatcttccgcatcctggcctccatcctgcacctgggcaacgtctactttgagaagtatgagacggatgcacaggaggtggcctcagtggtgagtgcccgagagatccaggccgtggcagagctgctgcagatctcccctgagggcctgcagaaggccatcaccttcaaagtgaccgagacaatgcgagagaagatcttcacgcccctaactgtggagagcgctgtggatgccagggacgccatcgccaaggtcttgtatgcactgctgttcagctggctcatcaccagggtcaacgcgctggtgtccccaaggcaggacacactgtccatcgccatcctggacatctatggtttcgaggacctgagcttcaacagctttgagcagctgtgtattaactacgcaaacgagaaccttcagtaccttttcaacaagatcgtcttccaggaggagcaggaggagtacatccgtgagcagatagactggcaggagatcacctttgctgacaaccagccctgcatcaacctcatctcactgaagccttatggcatcctgcggatccttgacgaccagtgttgctttccccaggctacagaccacaccttcctacagaagtgccactaccatcatggcgccaacccgctctattccaaacccaagatgccgctgcctgagttcaccatcaagcactatgcaggcaaggtcacctaccaggtgcacaagttcctggacaagaaccacgaccaagtgcgccaggatgtgctggacctgttcgtacggagccggacacgggtggtggcacacctcttctccagccatgccccacaggctgcccctcagcgcctgggcaagagcagctccgtcactcggctctacaaggcgcacactgtggccgccaagttccagcagtcactcctggatctggtggaaaagatggagaggtgcaaccccttgttcatgcgttgcctgaagcccaaccacaagaaggagccaggtctctttgagccagatgtggtaatggcacaattacgctattcaggggtgctggagaccgtgaggatccgcaaggagggatttccagtgcgcctgcctttccaggggttcatcgacaggtactgctgtctagtggccctcaagcatgacctgccggctaatggggacatgtgtgtgtcagtgctgagtcgcctgtgcaaagtcatgccaaacatgtaccgtgttggggtcagcaagctgttccttaaggaacacctataccagctgctggagagtatgcgagagcatgtcctgaatctggcagccctcactctgcagcgctgcctccgtggcttcttcattaagcggcgattccgctctctgcgccacaagatcatcctgctgcaaagccgggcccgtggctaccttgccaggcaacgctatcagcagatgaggaggagtctggtgaagttccggtccctggtacacgcatacgtgagccgccgacgctatctcaagctgagggcagagtggaggtgccaggtggagggggcgctgctgtgggagcaggaggagctgagcaagcgggaggtagtcgctgtggggcacctggaggtaccggctgagctggctgggctcttgcaagcagtggcaggcctcgggctggcccaggtgcctcaggtggcccctgtgaggactcctcgactccaggctgagccccgtgtcacactgcccctggacatcaacaactatcctatggccaagtttgtccagtgccacttcaaggaacctgcctttgggatgctgacagtgcccctgaggacacccctcacgcagctgccagccgagcaccatgcagaagccgtgagcatcttcaagctgatcctgcgcttcatgggcgacccccacctgcatggtgcccgggagaacatcttcgggaactacatcgtgcagaaggggctggcggtgcctgagctgcgggatgagatcctggcacagctggccaatcaggtgtggcacaatcacaatgcccacaatgctgagcggggctggctgctgctggccgcctgcctcagtggctttgcaccttccccgtgcttcaacaagtaccttctcaagtttgtgtctgattatgggcggaatggcttccaggctgtgtgtcagcaccgcctcatgcaggccatgggccgggcccaacagcagggctcgggggctgcccgcaccttacccccgacccagctcgagtggacagcgacctatgagaaggccagcatggcgctggacgtgggctgcttcaatggtgaccagttctcctgcccggtgcactcctggagtacgggggaagaggtggctggagacattctgaggcacagggggctggcagatggctggcgcggctggaccgtggccatgaagaatggtgtccagtgggcagagctggctggccacgactacgtgttagacctggtgtcggacctggagctgctcagggacttccctcgacagaagtcctacttcattgtgggcacagaggggcctgcagccagcaggggaggccccaaagtggtgtttgggaacagctgggactcggatgaggacatgtccactagaccccagccccaggagcacatgcccaaagtacttgactctgatgggtacagcagccacaatcaggacggtacaaatggggagactgaggcccaaagagggacagcaacccaccaagagtcagacagtcttggagagcctgctgtgccccacaaggggctggactgctacctggatagcctctttgaccctgtgctgtcctacggggatgcggacctggagaagccaacagccattgcctaccgcatgaaagggggaggccagcccggtggaggcagcagtagtggtactgaagacacccccaggagacccccagagccaaagccaatcccaggcctggatgcctccacattggctctgcagcaagccttcatccacaaacaggccgtgctgctggcccgggagatgaccctgcaggccacggcactccagcagcagcccctgagtgctgccctgagatccttgcccgcagagaaacccccagcaccagaggcacagccgacgtctgtaggcaccggtccccctgccaaacccgtgctcctgcgtgccactccaaagcccttggccccagcccctctggccaaggctccaaggctccccatcaagcctgtggctgcccctgttctagctcaggatcaggcttctccagaaaccacttcaccctccccagagctggtccggtactctacgctcaactctgagcacttcccacagcccacacagcagatcaagaatattgtcaggcagtaccagcagccgttccggggaggccggcctgaggccctcaggaaggatggcgggaaagtgttcatgaagcggccagaccctcatgaggaggccctgatgatcctgaaagggcagatgacccacctggcagctgcacctggcacccaggtgtccagagaggccgtggccctggtgaagccggtgaccagtgcaccaaggccatccatggcacccacttcagctctgccctcgcgatcgctggagccccctgaggaactcacgcagacgcggctgcaccgcctcatcaatcccaacttctacggctatcaggacgccccctggaagatcttcctgcgcaaagaggtgttttaccccaaggacagctacagccatcctgtgcagcttgacctcctgttccggcagatcctgcacgacacgctctccgaggcctgccttcgcatctctgaggatgagaggctcaggatgaaggccttgtttgcccagaaccagctggacacacagaagcctctggtaacggaaagcgtgaagcgggccgtggtcagcactgcacgagacacctgggaggtctacttctcccgcatcttccccgccacgggcagcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggactctgactacgtggtcgctgtgaggaacttcctgcctgaggaccctgcgctgctggctttccacaagggtgacatcatacacctgcagcccctagagccacctcgagtgggctacagtgctggctgcgtggttcgcaggaaggtggtgtacctggaggagctgcgacgtagaggccccgactttggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagagggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggccagcatgtgtgcccactcagtcgccgtgcttacatcctggatgtggcctcagagatggagcaggtggacggcggctacatgctctggttccggcgtgtgctctgggatcagccactcaagttcgagaatgagctatatgtgaccatgcactacaaccaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgaattgatggtgaagttccccctgaaggagatccagtcgacgcggacccagcggcccacggccaactccagctacccctatgtggagattgcgctgggggacgtggcggcccagcgcaccttgcagctgcagctggagcagggactggaactgtgtcgtgtggtggccgtgcacgtggagaacctgctcagtgcccatgagaagcggctcacattgccccccagcgagatcaccctgctctgacccagcccccagccctccagtaccttctgccagaagactcactgtgtggcctcagagaaatcactgaacctctcaggatcaatgacccctgtaaggggccagagccttggaggacactaagaggaggcaggaggagcaactcaaatccccaagaacacaagaagacccatcctgaactgggatggaatggcagcatgcaaacttggatcagatagcaggaggaactttcaaaagtctggcccactgtgcagtggagcagaaggcaggaccatgaggcctcctgccatgtacccattgcagaccctgcccctaactcctgcctatgacacagaagccccacaccagttgcccagatgaactggcctctgcctttggtttactcagggtctgatgttggaatctgctccaactccacaccctagcccttacatgtcctcctaaggggcccctccttgtgctgccagtcagcctggatttctggtctttggttatttctgtgcaaacaaaaggtgtgcctggcagccatttctccatggagttgctaagtggccggaaaacaagcctgagggaggaggcaggagttggagttaccttaggcccctgattcactgcctatgaacagaccatcccccactccttgggtatccccaaccccagacccccatcacttgatgggccacacaagtttgagagtggtacaagggagaagtttgggaaaagccttcttggaaaatgggacattagcattgagttttgaaagatgagtaggagtttgctaagaatagatggaagacagcaggataaacattccagagaaaatcatgtttattccctgctgtatcttccagaacctaggaggatgcctaacagagagtaagcacttaaaaaatatttgtcatatgaatgaaaaaataaacgagtgaatgttgata

SEQ ID NO: 156905 - DNA, 3411 bp, Homo sapiens
  Payload ID: 10751
  Gene Symbol: MYO15A
  Gene Name: myosin XVA
  Uniprot ID: Q9UKN7
  ENST ID: ENST00000418233
  CDS Start-End: 623-3016
tcatcctaggaggtgcctgtggccgggcgcagtagctcatgcctgtaatcccagcactttgggaggccgaggcgggcggaccacctgaggtcaggaatttgagactagccggcccaacatggcgaaaccccatctctactaaacatacaaaaaattagccaggcgtcgtggcgggcgcctgtaatcccagctactcaggaggctgaggcaggagaatcgcttgaacccaggaggcggagcttgcagtgggccgagattgcgccactgcactctagcctgggggacaacagcgaaactccgtctcaaaaatatatatatatattaattaaataaaaaaacgaggtgccttctcctgactccctgatccccgcgctctccagctctgccctcgcgatcgctggagccccctgaggaactcacgcagacgcggctgcaccgcctcatcaatcccaacttctacggctatcaggacgccccctggaagatcttcctgcgcaaagaggtgttttaccccaaggacagctacagccatcctgtgcagcttgacctcctgttccggcagatcctgcacgacacgctctccgaggcctgccttcgcatctctgaggatgagaggctcaggatgaaggccttgtttgcccagaaccagctggacacacagaagcctctggtaacggaaagcgtgaagcgggccgtggtcagcactgcacgagacacctgggaggtctacttctcccgcatcttccccgccacgggcagcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggactctgactacgtggtcgctgtgaggaacttcctgcctgaggaccctgcgctgctggctttccacaagggtgacatcatacacctgcagcccctagagccacctcgagtgggctacagtgctggctgcgtggttcgcaggaaggtggtgtacctggaggagctgcgacgtagaggccccgactttggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagagggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggccagcatgtgtgcccactcagtcgccgtgcttacatcctggatgtggcctcagagatggagcaggtggacggcggctacatgctctggttccggcgtgtgctctgggatcagccactcaagttcgagaatgagctatatgtgaccatgcactacaaccaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgaattgatggtgaagttccccctgaaggagatccagtcgacgcggacccagcggcccacggccaactccagctacccctatgtggagattgcgctgggggacgtggcggcccagcgcaccttgcagctgcagctggagcaggtaagagctggggaagtgttggatgggcgtggactgtcactgtcacctgcagggactggaactgtgtcgtgtggtggccgtgcacgtggagaacctgctcagtgcccatgagaagcggctcacattgccccccagcgagatcaccctgctctgacccagcccccagccctccagtaccttctgccagaagactcactgtgtggcctcagagaaatcactgaacctctcaggatcaatgacccctgtaaggggccagagccttggaggacactaagaggaggcaggaggagcaactcaaatccccaagaacacaagaagacccatcctgaactgggatggaatggcagcatgcaaacttggatcagatagcaggaggaactttcaaaagtctggcccactgtgcagtggagcagaaggcaggaccatgaggcctcctgccatgtacccattgcagaccctgcccctaactcctgcctatgacacagaagccccacaccagttgccca

SEQ ID NO: 156906 - DNA, 573 bp, Homo sapiens
  Payload ID: 10751
  Gene Symbol: MYO15A
  Gene Name: myosin XVA
  ENST ID: ENST00000556535
  CDS Start-End: 114-573
aagtggggcagggagccaggttagcacagcaagtaaaaggcgtgggcgggctgaagggggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagc

SEQ ID NO: 156907 - DNA, 517 bp, Homo sapiens
  Payload ID: 10751
  Gene Symbol: MYO15A
  Gene Name: myosin XVA
  ENST ID: ENST00000557655
  CDS Start-End: 110-217
ggggcagggagccaggttagcacagcaagtaaaaggcgtgggcgggctgaagggggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccg

SEQ ID NO: 156908 - DNA, 494 bp, Homo sapiens
  Payload ID: 10751
  Gene Symbol: MYO15A
  Gene Name: myosin XVA
  ENST ID: ENST00000585180
  CDS Start-End: 174-485
aagcaaggccagggggcagtcggacagtacccactgaagccccgcccctgcaggtgttttaccccaaggacagctacagccatcctgtgcagcttgacctcctgttccggcagatcctgcacgacacgctctccgaggcctgccttcgcatctctgaggatgagaggctcaggatgaaggccttgtttgcccagaaccagctggacacacagaagcctctggtaacggaaagcgtgaagcgggccgtggtcagcactgcacgagacacctgggaggtctacttctcccgcatcttccccgccacgcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcat

SEQ ID NO: 156909 - DNA, 998 bp, Homo sapiens
  Payload ID: 10751
  Gene Symbol: MYO15A
  Gene Name: myosin XVA
  ENST ID: ENST00000579848
  CDS Start-End: 1-774
ctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgtaagagctggggaagtgttggatgggcgtggactgtcactgtcacctgcagggactggaactgtgtcgtgtggtggccgtgcacgtggagaacctgctcagtgcccatgagaagcggctcacattgccccccagcgagatcaccctgctctgacccagcccccagccctccagtaccttctgccagaagactcactgtgtggcctcagagaaatcactgaacctctc

SEQ ID NO: 156910 - DNA, 1046 bp, Homo sapiens
  Payload ID: 10751
  Gene Symbol: MYO15A
  Gene Name: myosin XVA
  ENST ID: ENST00000578575
  CDS Start-End: 1-361
cagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggtcctgcctgactacctgaagggactcttcagcagtgtgccggccagccggcccagcgagcagctgctgcagcaggtgtccaagctggcttcactgcagcatcgcgccaaggaccacttctacctgccgagcgtgacctcgtggccgggcatggtggtgcacgcctgtaacgccagctactcgggaggctgaggcagaagaattgcttgaacgcaagaggcagaggttgcagtgagctgagattgtaccactacactccagcctgggcaatagagcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgtaagagctggggaagtgttggatgggcgtggactgtcactgtcacctgcagggactggaactgtgtcgtgtggtggccgtgcacgtggagaacctgctcagtgcccatgagaagcggctcacattgccccccagcgagatcaccctgctctga

SEQ ID NO: 156911 - DNA, 568 bp, Homo sapiens
  Payload ID: 10751
  Gene Symbol: MYO15A
  Gene Name: myosin XVA
  ENST ID: ENST00000578472
  CDS Start-End: 200-568
aagtaaaaggcgtgggcgggctgaagggggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctg

SEQ ID NO: 156912 - DNA, 11860 bp, Homo sapiens
  Payload ID: 10751
  Gene Symbol: MYO15A
  Gene Name: myosin XVA
  ENST ID: ENST00000615845
  CDS Start-End: 339-10931
gggctgggcctcccttccccataacactgagctgctctgctgggccaaccgtgctcctgggccagccagaggacccccatgaggcggcatgcaggcggggagcaggccacagaacgcagggtgaaacccaaggcgctctagaggagatgaattatggatccgccctcccggaatcctggctcggccctccccacgccacccagggccagtcgggtctgctcacagcccgaggaggccgcgtgtccagccgcgggcaagagacagagcaggtccctgtgtctccaagtccctgagcccgtgacaccggccccaggccctgtagagagcaggcagccaccatggcgaaggaggaagatgaggagaagaaagccaagaaagggaagaaggggaagaaggcaccggagccggagaagcccaaacggagcctgaaggggacgtcgcggctgttcatgggcttccgcgaccgtacacccaagatctccaagaagggccagttccgcagcgcctcggccttcttctggggcctccacaccggcccccagaagaccaagcgcaagaggaaggcccgcaccgtgctcaagtccacgtcaaagctcatgacgcagatgcgcatgggcaagaagaagcgggcgatgaagggcaagaagccgtccttcatggtgatccgcttcccaggccgccgtggctacggccgcctgcggccgcgcgcccggtcactcagcaaagcgtccacggccatcaactggctcacaaaaaagttcctcctcaagaaggccgaggagtcgggcagcgaacaggccacagtggacgcctggctgcagcgctcgagctcccgcatgggctcccgcaaactccccttcccgtcgggtgccgagatcctgcggcctgggggccggctccggaggttcccccgcagccgcagcatctacgcgtcaggcgagcccctgggcttcctgcccttcgaggacgaggccccattccatcactcgggctcccgcaagtcgctgtacgggcttgagggcttccaggacctgggcgagtattatgactatcaccgcgacggcgacgactactacgaccggcagtcactccaccgctacgaggagcaggaaccctacctggcgggcctcggcccctacagcccggcctggccaccctacggcgaccactactacgggtacccgcccgaggatccctacgactactaccaccccgactattacggtggcccctttgatccggggtacacctacggctacggctacgacgattacgaacccccatatgcgcccccgtcggggtactcgtctccttacagctaccacgatgggtacgagggcgaggcgcacccttatggctactacctggatccctatgcgccgtacgacgcgccatacccaccctatgacctcccataccacactccctacgatgtaccctactttgatccctacggagtccactacaccgtcccctatgccgaaggcgtctatggcggtggggacgaggccatctacccccccgaggtgccctatttttacccggaggagtcggcttcggcctttgtgtacccctgggtaccaccgcccatcccgtcgccccacaacccgtatgcccacgccatggatgacatcgccgagctggaggaaccagaggacgcgggcgtagagcgtcaggggacctccttccgcctgcccagcgccgccttcttcgagcagcaaggcatggataagcccgccaggtccaagctgtccctcatccgcaagttccgcctcttcccgcgaccccaggtgaagctgtttgggaaggagaagctggaggtgcccctgccaccctctctggacattcctctccccttgggggatgcggacgaagaagaggacgaggaggagctgcccccggtttccgctgtgccctacggccaccctttctggggcttcctcacgccgcgccagcgcaacctccagcgcgcgctgtcggccttcggcgcccaccggggcctgggcttcggccctgagtttggccgccccgtgcctcgccctgccacctcgcttgcgcggttcctcaagaagacgctgtcggagaagaagcccatcgcgcggctcaggggcagccagaaggcccgggcgggcggccctgctgtcagggaggcggcctacaaacgcttcggctacaagctggctggcatggaccccgagaagcccggcacgcccatcgtgctgaggagggcccagccacgcgctcgcagcagcaacgacgcgcgccgcccgcccgcgccacagcccgcgcccaggaccctctcccactggagcgcgctcctgtctccgcccgtgcccccgcggcccccaagctccgggcccccgcccgcgccgccgctctccccggcgctctcgggcctgccccggccggcctcgccctacggctccctccgccgccacccgccgccctgggccgccccagcgcacgtgccaccggcgccgcaggccagctggtgggccttcgtggagccccctgccgtgagcccggaggtgccccccgacctactagccttcccagggccccgaccctcgttcaggggctcccgccggagaggggcggctttcggcttccccggggcctctccacgggcgtcgcggaggcgagcttggtcaccgctggcctcgccccagccctcgctgaggagctcgccgggcctcggctactgctcacccttggcgcccccgtcgcctcagctgtccttgcgcacgggccccttccagccgcccttcctgcccccggcccgccggccccgctcgctgcaggagtccccagccccacgccgagccgctgggcgcctgggcccacccggctcgccgctgccgggctcacccaggccgccctcgccgcccctggggctctgccacagcccgcggcgcagctccctgaatctgccctcgcgcctcccgcacacgtggcggcgcctcagcgagccacccactcgggctgtgaagccgcaagtgcgcctgcccttccaccgaccgcccagggccggggcctggcgggcgcccctggaacaccgggagagcccgcgagaacccgaggactcagagacgccctggactgtgcccccactggcccccagctgggacgtggacatgcctcccacccaacgcccaccctccccctggccaggaggtgcaggcagccgccgaggcttttccaggccaccccctgtgccggaaaacccctttctccagctcctgggccctgtgccatcccccaccctccagcctgaggatccagctgctgatatgaccagggtcttcctgggcagacaccatgagccggggcctggacagctcaccaaatcagctggcccaacccctgagaagcctgaagaagaggccaccctgggggacccccagctgccagcagagaccaagcctccaaccccagcacctcccaaggatgtcactccccccaaggatatcactccccccaaggatgtcctcccagagcaaaagacattaaggcccagcctctcatacccactggctgcgtgtgaccagaccagggccacatggccaccatggcaccgctggggaacactgccccaagccgcagcccccttggcgcccatcagggccccagagcccctgcccaaggggggtgaacggcgccaggcagcccctgggcgttttgctgtggtcatgcctcgtgtgcagaagctgagctctttccagcgagttgggcctgcaaccctgaagcctcaagtccagcccattcaggaccccaagccaagagcctgtagtcttcgctggtcctgcctctggcttcgggcagatgcctatggaccctggccacgagtacacacccatccccagtcctgccacctgggccctggagctgcctgcctgtcccttaggggctcctgggaggaggtcggcccgccaagctggcggaacaagatgcactccatccgcaacctgccatccatgcggttccgtgagcagcacggggaggatggtgtggaggacatgacacagctggaagacctccaggaaaccactgtgctgtccaacctcaagattagatttgaacggaacctcatctacacatacattgggagcatcctggtgtcggtgaacccataccaaatgtttggaatctatgggccggagcaggtgcagcagtacaacggacgggccctgggagagaatcccccgcacctctttgctgttgcaaatctcgccttcgccaaaatgctcgatgccaaacagaaccagtgcataatcattagtggagagagcggctctggcaaaactgaggccaccaagctgattctgcgctacctggccgccatgaaccagaaacgggaggtcatgcagcaggtccagatcctggaggcaacacccctcttggagtccttcggtaatgccaaaaccgtcaggaacgacaactccagccgctttgggaagtttgtggaaatctttctggaagggggcgtgatctctggtgccataacctcccagtacctgcttgagaaatccaggatcgtgtttcaggccaaaaacgagaggaattaccacatcttctacgagttgctggccgggttgcctgcccagctcaggcaggcctttagcctgcaagaggctgagacctactactatctgaaccagggtgggaactgtgagatagcaggaaagagcgatgcagatgactttcgccggctcctggctgccatggaggtgttgggcttcagcagtgaggaccaggacagcatcttccgcatcctggcctccatcctgcacctgggcaacgtctactttgagaagtatgagacggatgcacaggaggtggcctcagtggtgagtgcccgagagatccaggccgtggcagagctgctgcagatctcccctgagggcctgcagaaggccatcaccttcaaagtgaccgagacaatgcgagagaagatcttcacgcccctaactgtggagagcgctgtggatgccagggacgccatcgccaaggtcttgtatgcactgctgttcagctggctcatcaccagggtcaacgcgctggtgtccccaaggcaggacacactgtccatcgccatcctggacatctatggtttcgaggacctgagcttcaacagctttgagcagctgtgtattaactacgcaaacgagaaccttcagtaccttttcaacaagatcgtcttccaggaggagcaggaggagtacatccgtgagcagatagactggcaggagatcacctttgctgacaaccagccctgcatcaacctcatctcactgaagccttatggcatcctgcggatccttgacgaccagtgttgctttccccaggctacagaccacaccttcctacagaagtgccactaccatcatggcgccaacccgctctattccaaacccaagatgccgctgcctgagttcaccatcaagcactatgcaggcaaggtcacctaccaggtgcacaagttcctggacaagaaccacgaccaagtgcgccaggatgtgctggacctgttcgtacggagccggacacgggtggtggcacacctcttctccagccatgccccacaggctgcccctcagcgcctgggcaagagcagctccgtcactcggctctacaaggcgcacactgtggccgccaagttccagcagtcactcctggatctggtggaaaagatggagaggtgcaaccccttgttcatgcgttgcctgaagcccaaccacaagaaggagccaggtctctttgagccagatgtggtaatggcacaattacgctattcaggggtgctggagaccgtgaggatccgcaaggagggatttccagtgcgcctgcctttccaggggttcatcgacaggtactgctgtctagtggccctcaagcatgacctgccggctaatggggacatgtgtgtgtcagtgctgagtcgcctgtgcaaagtcatgccaaacatgtaccgtgttggggtcagcaagctgttccttaaggaacacctataccagctgctggagagtatgcgagagcatgtcctgaatctggcagccctcactctgcagcgctgcctccgtggcttcttcattaagcggcgattccgctctctgcgccacaagatcatcctgctgcaaagccgggcccgtggctaccttgccaggcaacgctatcagcagatgaggaggagtctggtgaagttccggtccctggtacacgcatacgtgagccgccgacgctatctcaagctgagggcagagtggaggtgccaggtggagggggcgctgctgtgggagcaggaggagctgagcaagcgggaggtagtcgctgtggggcacctggaggtaccggctgagctggctgggctcttgcaagcagtggcaggcctcgggctggcccaggtgcctcaggtggcccctgtgaggactcctcgactccaggctgagccccgtgtcacactgcccctggacatcaacaactatcctatggccaagtttgtccagtgccacttcaaggaacctgcctttgggatgctgacagtgcccctgaggacacccctcacgcagctgccagccgagcaccatgcagaagccgtgagcatcttcaagctgatcctgcgcttcatgggcgacccccacctgcatggtgcccgggagaacatcttcgggaactacatcgtgcagaaggggctggcggtgcctgagctgcgggatgagatcctggcacagctggccaatcaggtgtggcacaatcacaatgcccacaatgctgagcggggctggctgctgctggccgcctgcctcagtggctttgcaccttccccgtgcttcaacaagtaccttctcaagtttgtgtctgattatgggcggaatggcttccaggctgtgtgtcagcaccgcctcatgcaggccatgggccgggcccaacagcagggctcgggggctgcccgcaccttacccccgacccagctcgagtggacagcgacctatgagaaggccagcatggcgctggacgtgggctgcttcaatggtgaccagttctcctgcccggtgcactcctggagtacgggggaagaggtggctggagacattctgaggcacagggggctggcagatggctggcgcggctggaccgtggccatgaagaatggtgtccagtgggcagagctggctggccacgactacgtgttagacctggtgtcggacctggagctgctcagggacttccctcgacagaagtcctacttcattgtgggcacagaggggcctgcagccagcaggggaggccccaaagtggtgtttgggaacagctgggactcggatgaggacatgtccactagaccccagccccaggagcacatgcccaaagtacttgactctgatgggtacagcagccacaatcaggacggtacaaatggggagactgaggcccaaagagggacagcaacccaccaagagtcagacagtcttggagagcctgctgtgccccacaaggggctggactgctacctggatagcctctttgaccctgtgctgtcctacggggatgcggacctggagaagccaacagccattgcctaccgcatgaaagggggaggccagcccggtggaggcagcagtagtggtactgaagacacccccaggagacccccagagccaaagccaatcccaggcctggatgcctccacattggctctgcagcaagccttcatccacaaacaggccgtgctgctggcccgggagatgaccctgcaggccacggcactccagcagcagcccctgagtgctgccctgagatccttgcccgcagagaaacccccagcaccagaggcacagccgacgtctgtaggcaccggtccccctgccaaacccgtgctcctgcgtgccactccaaagcccttggccccagcccctctggccaaggctccaaggctccccatcaagcctgtggctgcccctgttctagctcaggatcaggcttctccagaaaccacttcaccctccccagagctggtccggtactctacgctcaactctgagcacttcccacagcccacacagcagatcaagaatattgtcaggcagtaccagcagccgttccggggaggccggcctgaggccctcaggaaggatggcgggaaagtgttcatgaagcggccagaccctcatgaggaggccctgatgatcctgaaagggcagatgacccacctggcagctgcacctggcacccaggtgtccagagaggccgtggccctggtgaagccggtgaccagtgcaccaaggccatccatggcacccacttcagctctgccctcgcgatcgctggagccccctgaggaactcacgcagacgcggctgcaccgcctcatcaatcccaacttctacggctatcaggacgccccctggaagatcttcctgcgcaaagaggtgttttaccccaaggacagctacagccatcctgtgcagcttgacctcctgttccggcagatcctgcacgacacgctctccgaggcctgccttcgcatctctgaggatgagaggctcaggatgaaggccttgtttgcccagaaccagctggacacacagaagcctctggtaacggaaagcgtgaagcgggccgtggtcagcactgcacgagacacctgggaggtctacttctcccgcatcttccccgccacgggcagcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggactctgactacgtggtcgctgtgaggaacttcctgcctgaggaccctgcgctgctggctttccacaagggtgacatcatacacctgcagcccctagagccacctcgagtgggctacagtgctggctgcgtggttcgcaggaaggtggtgtacctggaggagctgcgacgtagaggccccgactttggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagagggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggccagcatgtgtgcccactcagtcgccgtgcttacatcctggatgtggcctcagagatggagcaggtggacggcggctacatgctctggttccggcgtgtgctctgggatcagccactcaagttcgagaatgagctatatgtgaccatgcactacaaccaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgaattgatggtgaagttccccctgaaggagatccagtcgacgcggacccagcggcccacggccaactccagctacccctatgtggagattgcgctgggggacgtggcggcccagcgcaccttgcagctgcagctggagcagggactggaactgtgtcgtgtggtggccgtgcacgtggagaacctgctcagtgcccatgagaagcggctcacattgccccccagcgagatcaccctgctctgacccagcccccagccctccagtaccttctgccagaagactcactgtgtggcctcagagaaatcactgaacctctcaggatcaatgacccctgtaaggggccagagccttggaggacactaagaggaggcaggaggagcaactcaaatccccaagaacacaagaagacccatcctgaactgggatggaatggcagcatgcaaacttggatcagatagcaggaggaactttcaaaagtctggcccactgtgcagtggagcagaaggcaggaccatgaggcctcctgccatgtacccattgcagaccctgcccctaactcctgcctatgacacagaagccccacaccagttgcccagatgaactggcctctgcctttggtttactcagggtctgatgttggaatctgctccaactccacaccctagcccttacatgtcctcctaaggggcccctccttgtgctgccagtcagcctggatttctggtctttggttatttctgtgcaaacaaaaggtgtgcctggcagccatttctccatggagttgctaagtggccggaaaacaagcctgagggaggaggcaggagttggagttaccttaggcccctgattcactgcctatgaacagaccatcccccactccttgggtatccccaaccccagacccccatcacttgatgggccacacaagtttgagagtggtacaagggagaagtttgggaaaagccttcttggaaaatgggacattagcattgagttttgaaagatgagtaggagtttgctaagaatagatggaagacagcaggataaacattccagagaaaatcatgtttattccctgctgtatcttccagaacctaggaggatgcctaacagagagtaagcacttaaaaaatatttgtcatatgaatgaaaaaataaacgagtgaatgttg

SEQ ID NO: 156913 - DNA, 567 bp, Homo sapiens
  Payload ID: 10752
  Gene Symbol: MYO15B
  Gene Name: myosin XVB
  ENST ID: ENST00000580096
  CDS Start-End: 1-61
gctgccggtggccaccctggagccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggcccca

SEQ ID NO: 156914 - DNA, 6323 bp, Homo sapiens
  Payload ID: 10752
  Gene Symbol: MYO15B
  Gene Name: myosin XVB
  ENST ID: ENST00000633867
  CDS Start-End: 1-4593
atgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgccggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaagggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgc

SEQ ID NO: 156915 - DNA, 834 bp, Homo sapiens
  Payload ID: 10752
  Gene Symbol: MYO15B
  Gene Name: myosin XVB
  ENST ID: ENST00000578220
  CDS Start-End: 1-834
ggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccgctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacat

SEQ ID NO: 156916 - DNA, 8646 bp, Homo sapiens
  Payload ID: 10752
  Gene Symbol: MYO15B
  Gene Name: myosin XVB
  ENST ID: ENST00000621743
  CDS Start-End: 1-4632
atgggcaggaaccagcgcaaagcgccccagcgcctggagaggcccgggaggccggcctcaggggagcaggagtcggggtcggccagcgcggatggcgcgcccagccgggaacgccgttccgaccgcgggcaggcggacagggcgaaaccggcggccgagcctgccaccgccgggggccagggaacccctggtggccgcaggaagcccactgcagaggggaacggcggctgcagacgcccaggggctgggctgtccccgaaagcccaggagaggcaaagcaacgcgcagcgtcagggacgcgggcccaggggcggccgcggggggcgcctggaggagggaagcctctccggaggagaagagctgggcggccgccgtaggaggaagcggaaagataaggggccctcggctcggcggggccgccggacgcccaggagcctcaatggggacacgtcgggtggggacggaggcagctcctgtccggacagcgaaacccgcgaggcccaggagagcggcagccagcgcggcacagcccgggagctgcggcccacgccggagcctacggacatgggctcggaagggacaaaaaccgggccggagtcagcgctggagccaagcagcgacggcctggacagcgactggccccacgcagatacccggggccgggaagggtcgtcggggacggggcccctgggagccagcgagcattccggcggggactccgactcgagtccgctggggaccggacctggacggggctctcgggcagctatggcctccaggaccttcgaggacagctcgcgggctcctcgggacactgggccggccaaggacgcgagcgacaaccgggcgcagcggggcgccgagccagaaacaatgcaggcctcgacggcccgggctccgcgccaccaggtcggaaaggcggtggggcaggtgccagcggcggcaggcgagggcgaagcgggagccgcagcaggagcggggccggaggacccagccccgctggcggccctcctggtggtccgcaggctcctcgcgaggcccccgccaggcgccgcttcccaggccgtgggcccccgccgcgctggcctcaaggagcggctcctgagtgtagcgcgagccctgggcctcctgcgctggctgcggcggcggctgcggctgcggcggcggccgccagagggcgaggggcagggtaccgggccacgggcgagcgaggggtggggccgccggaaaccggacgaggggcggggtcatgggagaggaagcaaggggcggggccgcgggaaagcggatgaagggcggggccacgagcgaggggacgagggtcggggccgcgggaaagcggacgaagggcggggccacgagcgagggtacgaggggcggggctgcgggaaagcggacgaggggcggggtcacgagagaggtgacgagggccgggaccaccagagagggtacgaggggtggggccgtgagcccgggctgcggcaccgtctagcgttgcgcctggctggcttagcagggctggggggtatgccgagggcttcccctggtggccgctccccgcaggtcccgacaagcccagtccccggcgacccttttgatcaggaggacgagactccagatcccaagttcgcggtcgtgttccccaggatccacagggcagggcgggcgtcgagcagccgcagctctgaagaagcgtccgcagatgcccccacgggggaaggccgaggttggcctcgtgcaggggtgggggggcacagtgaggggtgcaggacgagtggggaaggggtgtccgggcttcgtcgcggctccctccttgccccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcgacacatctttgccatcgtggcatcagcctatgacctggctcagaatactgggcaggacccatgcatcctcctgtgtgggcacagtggctcagggaagacggaagccgccaaaaagatcatgcagttcctaagcagcctggagcaggatcagacggggaaccgagagtgtcaggtggaggatatgctgcctatactcagcagctttggccatgccaagaccatcctcaatgccaatgccagccgcttcggccaggtcttctgcctctacctacagcaaggggtcatcgtgggagcctctgtgtctcattatctacttgagacctccagggtggtgtttcaggcccaggctgagcggagcttccatgttttttacaagctgctggcagggctggactccatagagcgggagcggctctccctgcagggaccggagacttactactacctcaaccagggccaggcctgcaggctgcaaggcaaggaggatgcccaggactttgaggggctgctgaaggcactgcaggggctcggcttgtgcccagaggagttgaatgccgtctgggctgtgctggccgccatcctgcagctgggcaacatctgcttctcctcctcagagcgagagtcccaggaggtggctgctgtgtctagctgggctgagatccacacagcagcccgactgctgcgggtaccaccagagtgcctggagggggctgtcaccaggagggtcacggagacgccctatggccaggtctcgcgatccctgcccgtggaaagtgcctttgatgccagggacgccctggccaaggcactgtattcccgcctcttccaccggcttctgaggagaaccaatgcacggctggcaccaccaggggagggaggcagcattggcaccgtcactgtcgtggatgcctacggctttgaggccctgcgggtgaatggcctggagcaactgtgcaacaacctcgccagcgagcgcctacagctcttctccagccagatgctgctggcccaggaggagcctccgagggagtcctgcctagacctcctggtagatcagccccacagcctcctgagtatcctggacgcccagacatggctgtcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggtctgcaggcgttggagccagggctgaagtgggtgggcctgtcttcacacattcctccaacagctgttggctgaccgtctgcctcatctacccttgggccagatgctggaagcggtacctccggcggcgggcagctttgggacagctgaacaccatcctgctggtggcccagcccctgctccagaggcggcagagactgcaggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgccggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatgggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgcgctagcccacgaccctgggctagaggtgggggcaggtggcaaggtgacctcagttcatgcccgatccctgcgcagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctggtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgctgacctgggggaccaagcagagcaggttccagggccccagcagtcagatttcctgcctgcaccctctccacccgcagaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactga

SEQ ID NO: 156917 - DNA, 5709 bp, Homo sapiens
  Payload ID: 10752
  Gene Symbol: MYO15B
  Gene Name: myosin XVB
  ENST ID: ENST00000584516
  CDS Start-End: 1-2283
atgggcaggaaccagcgcaaagcgccccagcgcctggagaggcccgggaggccggcctcaggggagcaggagtcggggtcggccagcgcggatggcgcgcccagccgggaacgccgttccgaccgcgggcaggcggacagggcgaaaccggcggccgagcctgccaccgccgggggccagggaacccctggtggccgcaggaagcccactgcagaggggaacggcggctgcagacgcccaggggctgggctgtccccgaaagcccaggagaggcaaagcaacgcgcagcgtcagggacgcgggcccaggggcggccgcggggggcgcctggaggagggaagcctctccggaggagaagagctgggcggccgccgtaggaggaagcggaaagataaggggccctcggctcggcggggccgccggacgcccaggagcctcaatggggacacgtcgggtggggacggaggcagctcctgtccggacagcgaaacccgcgaggcccaggagagcggcagccagcgcggcacagcccgggagctgcggcccacgccggagcctacggacatgggctcggaagggacaaaaaccgggccggagtcagcgctggagccaagcagcgacggcctggacagcgactggccccacgcagatacccggggccgggaagggtcgtcggggacggggcccctgggagccagcgagcattccggcggggactccgactcgagtccgctggggaccggacctggacggggctctcgggcagctatggcctccaggaccttcgaggacagctcgcgggctcctcgggacactgggccggccaaggacgcgagcgacaaccgggcgcagcggggcgccgagccagaaacaatgcaggcctcgacggcccgggctccgcgccaccaggtcggaaaggcggtggggcaggtgccagcggcggcaggcgagggcgaagcgggagccgcagcaggagcggggccggaggacccagccccgctggcggccctcctggtggtccgcaggctcctcgcgaggcccccgccaggcgccgcttcccaggccgtgggcccccgccgcgctggcctcaaggagcggctcctgagtgtagcgcgagccctgggcctcctgcgctggctgcggcggcggctgcggctgcggcggcggccgccagagggcgaggggcagggtaccgggccacgggcgagcgaggggtggggccgccggaaaccggacgaggggcggggtcatgggagaggaagcaaggggcggggccgcgggaaagcggatgaagggcggggccacgagcgaggggacgagggtcggggccgcgggaaagcggacgaagggcggggccacgagcgagggtacgaggggcggggctgcgggaaagcggacgaggggcggggtcacgagagaggtgacgagggccgggaccaccagagagggtacgaggggtggggccgtgagcccgggctgcggcaccgtctagcgttgcgcctggctggcttagcagggctggggggtatgccgagggcttcccctggtggccgctccccgcaggtcccgacaagcccagtccccggcgacccttttgatcaggaggacgagactccagatcccaagttcgcggtcgtgttccccaggatccacagggcagggcgggcgtcgagcagccgcagctctgaagaagcgtccgcagatgcccccacgggggaaggccgaggttggcctcgtgcaggggtgggggggcacagtgaggggtgcaggacgagtggggaaggggtgtccgggcttcgtcgcggctccctccttgccccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcggttagcgggcgcggtgccaaagctgccatccccggctcacagctcctcatatccaccctgccctcatctttatgaattgcgtgtagacccttattgaatccttagaaggatgggcttgaaccctcctggcaggaaggggcagacctttggggggcctgtcttgcttgttctgaacccccaccggtccttgcctcttttttcacctgaggtccaggcaagctaccaccccaggaaggccctcagcaccactccacacatctttgccatcgtggcatcagcctatgacctggctcagaatactgggcaggacccatgcatcctcctgtgctcctcccactgcagtgggcacagtggctcagggaagacggaagccgccaaaaagatcatgcagttcctaagcagcctggagcaggatcagacggggaaccgagagtgtcaggtggaggatatgctgcctatactcagcagctttggccatgccaagaccatcctcaatgccaatgccagccgcttcggccaggtcttctgcctctacctacagcaaggggtcatcgtgggagcctctgtgtctcattatctacttgagacctccagggtggtgtttcagctgctggcagggctggactccatagagcgggagcggctctccctgcagggaccggagacttactactacctcaaccagggccaggcctgcaggctgcaaggcaaggaggatgcccaggactttgaggggctgctgaaggcactgcaggggctcggcttgtgcccagaggagttgaatgccgtctgggctgtgctggccgccatcctgcagctgggcaacatctgcttctcctcctcagagggacgccctggccaaggcactgtattcccgcctcttccaccggcttctgaggagaaccaatgcacggctggcaccaccaggggagggaggcagcattggcaccgtcactgtcgtggatgcctacggctttgaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgccggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcaggtcagaaaagaaatgcccatgctggagcccttgtggaagtggagggccgtgagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggagga

SEQ ID NO: 156918 - DNA, 365 bp, Homo sapiens
  Payload ID: 10752
  Gene Symbol: MYO15B
  Gene Name: myosin XVB
  ENST ID: ENST00000582012
  CDS Start-End: 1-201
accaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccagcctgtcttcacacattcctccaacagctgttggctgaccgtctgcctcatctacccttgggccagatgctggaagcggtacctccggcggcgggcagctttgggacagctgaacaccatcctgctggtggcccagcccctgctccagaggcggcagagactgcagcttgggcgttggcagggctggcatagcagcgaaagg

SEQ ID NO: 156919 - DNA, 336 bp, Homo sapiens
  Payload ID: 10752
  Gene Symbol: MYO15B
  Gene Name: myosin XVB
  ENST ID: ENST00000584762
  CDS Start-End: 1-336
tgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccagacggagtttggttcttgttgcccaggctggagtgcaatggtgcggtctcggctcactgcaacctccacctcccaggccacggaccacaccttcctccagaagagccactatcaccatggtgaccaccccagctatgcc

SEQ ID NO: 156920 - DNA, 769 bp, Homo sapiens
  Payload ID: 10752
  Gene Symbol: MYO15B
  Gene Name: myosin XVB
  ENST ID: ENST00000583560
  CDS Start-End: 1-769
gttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaa

SEQ ID NO: 156921 - DNA, 903 bp, Homo sapiens
  Payload ID: 10752
  Gene Symbol: MYO15B
  Gene Name: myosin XVB
  ENST ID: ENST00000580414
  CDS Start-End: 1-577
caagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagtaagcttggggacggagcctcacggtggggccactcccctgcccaggggccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatgggg

SEQ ID NO: 156922 - DNA, 643 bp, Homo sapiens
  Payload ID: 10752
  Gene Symbol: MYO15B
  Gene Name: myosin XVB
  ENST ID: ENST00000577342
  CDS Start-End: 1-256
gcccaagcggccacaacccagcagggaaattggcaacatcatccgcatgtaccagagccgcccgggccccgtgcctgtgcccgtgcagccatccagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctggg

SEQ ID NO: 156923 - DNA, 709 bp, Homo sapiens
  Payload ID: 10752
  Gene Symbol: MYO15B
  Gene Name: myosin XVB
  ENST ID: ENST00000583140
  CDS Start-End: 1-469
ctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggc

SEQ ID NO: 156924 - DNA, 816 bp, Homo sapiens
  Payload ID: 10752
  Gene Symbol: MYO15B
  Gene Name: myosin XVB
  ENST ID: ENST00000577948
  CDS Start-End: 1-312
caggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccggaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagat

SEQ ID NO: 156925 - DNA, 493 bp, Homo sapiens
  Payload ID: 10752
  Gene Symbol: MYO15B
  Gene Name: myosin XVB
  ENST ID: ENST00000584723
  CDS Start-End: 1-316
tgcataccagccaggcatggtccctgcacccatgcccatgatgccagcaatgggcacagtccctgccatgccagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgca

SEQ ID NO: 156926 - DNA, 707 bp, Homo sapiens
  Payload ID: 10752
  Gene Symbol: MYO15B
  Gene Name: myosin XVB
  ENST ID: ENST00000580262
  CDS Start-End: 1-217
ccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggg

SEQ ID NO: 156927 - DNA, 9195 bp, Homo sapiens
  Payload ID: 10752
  Gene Symbol: MYO15B
  Gene Name: myosin XVB
  ENST ID: ENST00000610510
  CDS Start-End: 1-9195
atgggcaggaaccagcgcaaagcgccccagcgcctggagaggcccgggaggccggcctcaggggagcaggagtcggggtcggccagcgcggatggcgcgcccagccgggaacgccgttccgaccgcgggcaggcggacagggcgaaaccggcggccgagcctgccaccgccgggggccagggaacccctggtggccgcaggaagcccactgcagaggggaacggcggctgcagacgcccaggggctgggctgtccccgaaagcccaggagaggcaaagcaacgcgcagcgtcagggacgcgggcccaggggcggccgcggggggcgcctggaggagggaagcctctccggaggagaagagctgggcggccgccgtaggaggaagcggaaagataaggggccctcggctcggcggggccgccggacgcccaggagcctcaatggggacacgtcgggtggggacggaggcagctcctgtccggacagcgaaacccgcgaggcccaggagagcggcagccagcgcggcacagcccgggagctgcggcccacgccggagcctacggacatgggctcggaagggacaaaaaccgggccggagtcagcgctggagccaagcagcgacggcctggacagcgactggccccacgcagatacccggggccgggaagggtcgtcggggacggggcccctgggagccagcgagcattccggcggggactccgactcgagtccgctggggaccggacctggacggggctctcgggcagctatggcctccaggaccttcgaggacagctcgcgggctcctcgggacactgggccggccaaggacgcgagcgacaaccgggcgcagcggggcgccgagccagaaacaatgcaggcctcgacggcccgggctccgcgccaccaggtcggaaaggcggtggggcaggtgccagcggcggcaggcgagggcgaagcgggagccgcagcaggagcggggccggaggacccagccccgctggcggccctcctggtggtccgcaggctcctcgcgaggcccccgccaggcgccgcttcccaggccgtgggcccccgccgcgctggcctcaaggagcggctcctgagtgtagcgcgagccctgggcctcctgcgctggctgcggcggcggctgcggctgcggcggcggccgccagagggcgaggggcagggtaccgggccacgggcgagcgaggggtggggccgccggaaaccggacgaggggcggggtcatgggagaggaagcaaggggcggggccgcgggaaagcggatgaagggcggggccacgagcgaggggacgagggtcggggccgcgggaaagcggacgaagggcggggccacgagcgagggtacgaggggcggggctgcgggaaagcggacgaggggcggggtcacgagagaggtgacgagggccgggaccaccagagagggtacgaggggtggggccgtgagcccgggctgcggcaccgtctagcgttgcgcctggctggcttagcagggctggggggtatgccgagggcttcccctggtggccgctccccgcaggtcccgacaagcccagtccccggcgacccttttgatcaggaggacgagactccagatcccaagttcgcggtcgtgttccccaggatccacagggcagggcgggcgtcgagcagccgcagctctgaagaagcgtccgcagatgcccccacgggggaaggccgaggttggcctcgtgcaggggtgggggggcacagtgaggggtgcaggacgagtggggaaggggtgtccgggcttcgtcgcggctccctccttgccccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcgacacatctttgccatcgtggcatcagcctatgacctggctcagaatactgggcaggacccatgcatcctcctgtgtgggcacagtggctcagggaagacggaagccgccaaaaagatcatgcagttcctaagcagcctggagcaggatcagacggggaaccgagagtgtcaggtggaggatatgctgcctatactcagcagctttggccatgccaagaccatcctcaatgccaatgccagccgcttcggccaggtcttctgcctctacctacagcaaggggtcatcgtgggagcctctgtgtctcattatctacttgagacctccagggtggtgtttcaggcccaggctgagcggagcttccatgttttttacaagctgctggcagggctggactccatagagcgggagcggctctccctgcagggaccggagacttactactacctcaaccagggccaggcctgcaggctgcaaggcaaggaggatgcccaggactttgaggggctgctgaaggcactgcaggggctcggcttgtgcccagaggagttgaatgccgtctgggctgtgctggccgccatcctgcagctgggcaacatctgcttctcctcctcagagcgagagtcccaggaggtggctgctgtgtctagctgggctgagatccacacagcagcccgactgctgcgggtaccaccagagtgcctggagggggctgtcaccaggagggtcacggagacgccctatggccaggtctcgcgatccctgcccgtggaaagtgcctttgatgccagggacgccctggccaaggcactgtattcccgcctcttccaccggcttctgaggagaaccaatgcacggctggcaccaccaggggagggaggcagcattggcaccgtcactgtcgtggatgcctacggctttgaggccctgcgggtgaatggcctggagcaactgtgcaacaacctcgccagcgagcgcctacagctcttctccagccagatgctgctggcccaggaggagcctccgagggagtcctgcctagacctcctggtagatcagccccacagcctcctgagtatcctggacgcccagacatggctgtcccagacggagtttggttcttgttgcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggtctgcaggcgttggagccagggctgaagtgggtgggcctgtcttcacacattcctccaacagctgttggctgaccgtctgcctcatctacccttgggccagatgctggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgccggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaagggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgcgctagcccacgaccctgggctagaggtgggggcaggtggcaaggtgacctcagttcatgcccgatccctgcgcagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctggtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgctgacctgggggaccaagcagagcaggttccagggccccagcagtcagatttcctgcctgcaccctctccacccgcagaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactga

SEQ ID NO: 156928 - DNA, 4189 bp, Homo sapiens
  Payload ID: 10752
  Gene Symbol: MYO15B
  Gene Name: myosin XVB
  ENST ID: ENST00000612587
  CDS Start-End: 1-304
gttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcaggtcagaaaagaaatgcccatgctggagcccttgtggaagtggagggccgtgagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatgggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgc

SEQ ID NO: 156929 - DNA, 7167 bp, Homo sapiens
  Payload ID: 10752
  Gene Symbol: MYO15B
  Gene Name: myosin XVB
  ENST ID: ENST00000619501
  CDS Start-End: 1-2283
atgggcaggaaccagcgcaaagcgccccagcgcctggagaggcccgggaggccggcctcaggggagcaggagtcggggtcggccagcgcggatggcgcgcccagccgggaacgccgttccgaccgcgggcaggcggacagggcgaaaccggcggccgagcctgccaccgccgggggccagggaacccctggtggccgcaggaagcccactgcagaggggaacggcggctgcagacgcccaggggctgggctgtccccgaaagcccaggagaggcaaagcaacgcgcagcgtcagggacgcgggcccaggggcggccgcggggggcgcctggaggagggaagcctctccggaggagaagagctgggcggccgccgtaggaggaagcggaaagataaggggccctcggctcggcggggccgccggacgcccaggagcctcaatggggacacgtcgggtggggacggaggcagctcctgtccggacagcgaaacccgcgaggcccaggagagcggcagccagcgcggcacagcccgggagctgcggcccacgccggagcctacggacatgggctcggaagggacaaaaaccgggccggagtcagcgctggagccaagcagcgacggcctggacagcgactggccccacgcagatacccggggccgggaagggtcgtcggggacggggcccctgggagccagcgagcattccggcggggactccgactcgagtccgctggggaccggacctggacggggctctcgggcagctatggcctccaggaccttcgaggacagctcgcgggctcctcgggacactgggccggccaaggacgcgagcgacaaccgggcgcagcggggcgccgagccagaaacaatgcaggcctcgacggcccgggctccgcgccaccaggtcggaaaggcggtggggcaggtgccagcggcggcaggcgagggcgaagcgggagccgcagcaggagcggggccggaggacccagccccgctggcggccctcctggtggtccgcaggctcctcgcgaggcccccgccaggcgccgcttcccaggccgtgggcccccgccgcgctggcctcaaggagcggctcctgagtgtagcgcgagccctgggcctcctgcgctggctgcggcggcggctgcggctgcggcggcggccgccagagggcgaggggcagggtaccgggccacgggcgagcgaggggtggggccgccggaaaccggacgaggggcggggtcatgggagaggaagcaaggggcggggccgcgggaaagcggatgaagggcggggccacgagcgaggggacgagggtcggggccgcgggaaagcggacgaagggcggggccacgagcgagggtacgaggggcggggctgcgggaaagcggacgaggggcggggtcacgagagaggtgacgagggccgggaccaccagagagggtacgaggggtggggccgtgagcccgggctgcggcaccgtctagcgttgcgcctggctggcttagcagggctggggggtatgccgagggcttcccctggtggccgctccccgcaggtcccgacaagcccagtccccggcgacccttttgatcaggaggacgagactccagatcccaagttcgcggtcgtgttccccaggatccacagggcagggcgggcgtcgagcagccgcagctctgaagaagcgtccgcagatgcccccacgggggaaggccgaggttggcctcgtgcaggggtgggggggcacagtgaggggtgcaggacgagtggggaaggggtgtccgggcttcgtcgcggctccctccttgccccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcggttagcgggcgcggtgccaaagctgccatccccggctcacagctcctcatatccaccctgccctcatctttatgaattgcgtgtagacccttattgaatccttagaaggatgggcttgaaccctcctggcaggaaggggcagacctttggggggcctgtcttgcttgttctgaacccccaccggtccttgcctcttttttcacctgaggtccaggcaagctaccaccccaggaaggccctcagcaccactccgtatgtgactctgccccactgaccctctgctcacctcccaggcagcccagtccctgcatgtccccttgactgaggtcccggggcctgtgagcacctctgctacacctcggagggtcccaggtccccatgtctggcaaccttctcatctccctcagacacatctttgccatcgtggcatcagcctatgacctggctcagaatactgggcaggacccatgcatcctcctgtgctcctcccactgcagtgggcacagtggctcagggaagacggaagccgccaaaaagatcatgcagttcctaagcagcctggagcaggatcagacggggaaccgagagtgtcaggtggaggatatgctgcctatactcagcagctttggccatgccaagaccatcctcaatgccaatgccagccgcttcggccaggtcttctgcctctacctacagcaaggggtcatcgtgggagcctctgtgtctcattatctacttgagacctccagggtggtgtttcagggccaggcctgcaggctgcaaggcaaggaggatgcccaggactttgaggggctgctgaaggcactgcaggggctcggcttgtgcccagaggagttgaatgccgtctgggctgtgctggccgccatcctgcagctgggcaacatctgcttctcctcctcagagcgagagtcccaggaggtggctgctgtgtctagctgggctgagatccacacagcagcccgactgctgcgggtaccaccagagtgcctggagggggctgtcaccaggagggtcacggagacgccctatggccaggtctcgcgatccctgcccgtggaaagtgcctttgatgccagggacgccctggccaaggcactgtattcccgcctcttccaccggcttctgaggagaaccaatgcacggctggcaccaccaggggagggaggcagcattggcaccgtcactgtcgtggatgcctacggctttgaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgccggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgaggatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgc

SEQ ID NO: 156930 - DNA, 3492 bp, Homo sapiens; identical to SEQ ID NO: 156569
  Payload ID: 10753
  Gene Symbol: MYO16
  Gene Name: myosin XVI
  Uniprot ID: Q9Y6X6
  ENST ID: ENST00000251041
  CDS Start-End: 42-2864

SEQ ID NO: 156931 - DNA, 6874 bp, Homo sapiens; identical to SEQ ID NO: 156570
  Payload ID: 10753
  Gene Symbol: MYO16
  Gene Name: myosin XVI
  Uniprot ID: Q9Y6X6
  ENST ID: ENST00000356711
  CDS Start-End: 127-5703

SEQ ID NO: 156932 - DNA, 6779 bp, Homo sapiens; identical to SEQ ID NO: 156567
  Payload ID: 10753
  Gene Symbol: MYO16
  Gene Name: myosin XVI
  Uniprot ID: Q9Y6X6
  ENST ID: ENST00000357550
  CDS Start-End: 42-5618

SEQ ID NO: 156933 - DNA, 7436 bp, Homo sapiens; identical to SEQ ID NO: 156568
  Payload ID: 10753
  Gene Symbol: MYO16
  Gene Name: myosin XVI
  ENST ID: ENST00000457511
  CDS Start-End: 623-6265

SEQ ID NO: 156934 - DNA, 7504 bp, Homo sapiens
  Payload ID: 10754
  Gene Symbol: MYO18A
  Gene Name: myosin XVIIIA
  Uniprot ID: Q92614
  ENST ID: ENST00000531253
  CDS Start-End: 134-6253
ctggatgccgcgtctccgcttctgctgcctgccgggcgggctccggtggccgcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggc

SEQ ID NO: 156935 - DNA, 6479 bp, Homo sapiens
  Payload ID: 10754
  Gene Symbol: MYO18A
  Gene Name: myosin XVIIIA
  ENST ID: ENST00000530254
  CDS Start-End: 1-82
agtctccttgctctgggctgctccaggccaggccatgcggaaagtgtgttgttatgaggattcaatgaggagacctgtatgaagtgccttcccctgtgcctggctcatagcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 156936 - DNA, 7522 bp, Homo sapiens
  Payload ID: 10754
  Gene Symbol: MYO18A
  Gene Name: myosin XVIIIA
  Uniprot ID: Q92614
  ENST ID: ENST00000533112
  CDS Start-End: 263-6271
gcagggagtcacccggcgctgcggagctcagcacagccggccgggaggaggctccccctggagcacggggccaggccaggtgctggctacccctccggccgctgctacaacccttggcgaggggcagagcgcggggagagagccggggtcccggggctggaggaaacggccgctcagggagcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggc

SEQ ID NO: 156937 - DNA, 589 bp, Homo sapiens
  Payload ID: 10754
  Gene Symbol: MYO18A
  Gene Name: myosin XVIIIA
  ENST ID: ENST00000528564
  CDS Start-End: 1-589
ttttgagctgctaacggagccagagcagcatcagagcggagtctccttgctctgggctgctccaggccaggccatgcggctggactctgaggccgcctctcatgcccacagccaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggat

SEQ ID NO: 156938 - DNA, 7597 bp, Homo sapiens
  Payload ID: 10754
  Gene Symbol: MYO18A
  Gene Name: myosin XVIIIA
  Uniprot ID: Q92614
  ENST ID: ENST00000527372
  CDS Start-End: 182-6346
agctgcgccgcgctgcgctctgctccatccctgaccgggccgaggctgctggatgccgcgtctccgcttctgctgcctgccgggcgggctccggtggccgcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggc

SEQ ID NO: 156939 - DNA, 650 bp, Homo sapiens
  Payload ID: 10754
  Gene Symbol: MYO18A
  Gene Name: myosin XVIIIA
  ENST ID: ENST00000588791
  CDS Start-End: 1-280
tcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggtaacctgcagtggctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaat

SEQ ID NO: 156940 - DNA, 7501 bp, Homo sapiens
  Payload ID: 10754
  Gene Symbol: MYO18A
  Gene Name: myosin XVIIIA
  ENST ID: ENST00000628822
  CDS Start-End: 134-6250
ctggatgccgcgtctccgcttctgctgcctgccgggcgggctccggtggccgcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaacctgcagtggctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggc

SEQ ID NO: 156941 - DNA, 8565 bp, Homo sapiens
  Payload ID: 10755
  Gene Symbol: MYO18B
  Gene Name: myosin XVIIIB
  ENST ID: ENST00000335473
  CDS Start-End: 251-7954
gggaagggatgtgtgtcggtgtgtgtggagagggtgctccttcgctcctgctttcccggctcggtggggtcccttcgcggccacccggggagacgtcttagacagtcgtggttcctgtgatctgtgtcctctttgcagaagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttggattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaaggaatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcatctgtgccttctctatggccttgctacctgggattccagagagttgatggggtgcagataggggtaggactgttagaatagaaccaacccaaactgtgtgtagtttggggtgtatacttctatttctcttcctacatgtctacatgccatgaccttcctcctcctcttcacttggccagtttcagctcacttcctccaggaagtctttcctgatatatcaaactgaaacaaatgctcctcctccatgctcccttaatccccatgcttgtcgattatattcctttgccaattcatttctctatcctgtgtatgtataagtgtgtacaagcattcaagaaactgatgaatgatgaatgaatgaatgagccaaagaacaaataaatgagcccacacaccc

SEQ ID NO: 156942 - DNA, 8090 bp, Homo sapiens
  Payload ID: 10755
  Gene Symbol: MYO18B
  Gene Name: myosin XVIIIB
  ENST ID: ENST00000407587
  CDS Start-End: 170-7876
cacccggggagacgtcttagacagtcgtggttcctgtgatctgtgtcctctttgcagaagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttggattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcagcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaaggaatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggca
